(12) United States Patent
Tang et al.

(10) Patent No.: US 6,783,969 B1
(45) Date of Patent: Aug. 31, 2004

(54) CATHEPSIN V-LIKE POLYPEPTIDES

(75) Inventors: Y. Tom Tang, San Jose, CA (US); Ryle W. Goodrich, Los Angeles, CA (US); Vinod Asundi, Foster City, CA (US); Radoje T. Drmanac, Palo Alto, CA (US)

(73) Assignee: Nuvelo, Inc., Sunnyvale, CA (US)

( * ) Notice: Subject to any disclaimer, the term of this patent is extended or adjusted under 35 U.S.C. 154(b) by 189 days.

(21) Appl. No.: 09/799,451

(22) Filed: Mar. 5, 2001

(51) Int. Cl.$^7$ .................................................. C12N 9/50
(52) U.S. Cl. ........................ 435/219; 435/183; 435/212; 435/226; 530/350
(58) Field of Search ................................. 435/219, 226, 435/212, 183; 530/350

(56) References Cited

PUBLICATIONS

Santamaria et al. Cancer Research. Apr. 1998. 58:1624–1630.*

* cited by examiner

*Primary Examiner*—Carla J. Myers

(57) ABSTRACT

The present invention provides novel nucleic acids, novel polypeptide sequences encoded by these nucleic acids and uses thereof.

3 Claims, No Drawings

CATHEPSIN V-LIKE POLYPEPTIDES

1. BACKGROUND OF THE INVENTION

1.1 Technical Field

The present invention provides novel polynucleotides and proteins encoded by such polynucleotides, along with uses for these polynucleotides and proteins, for example in therapeutic, diagnostic and research methods.

1.2 Background

Technology aimed at the discovery of protein factors (including e.g., cytokines, such as lymphokines, interferons, CSFs, chemokines, and interleukins) has matured rapidly over the past decade. The now routine hybridization cloning and expression cloning techniques clone novel polynucleotides "directly" in the sense that they rely on information directly related to the discovered protein (i.e., partial DNA/amino acid sequence of the protein in the case of hybridization cloning; activity of the protein in the case of expression cloning). More recent "indirect" cloning techniques such as signal sequence cloning, which isolates DNA sequences based on the presence of a now well-recognized secretory leader sequence motif, as well as various PCR-based or low stringency hybridization-based cloning techniques, have advanced the state of the art by making available large numbers of DNA/amino acid sequences for proteins that are known to have biological activity, for example, by virtue of their secreted nature in the case of leader sequence cloning, by virtue of their cell or tissue source in the case of PCR-based techniques, or by virtue of structural similarity to other genes of known biological activity.

Identified polynucleotide and polypeptide sequences have numerous applications in, for example, diagnostics, forensics, gene mapping; identification of mutations responsible for genetic disorders or other traits, to assess biodiversity, and to produce many other types of data and products dependent on DNA and amino acid sequences.

2. SUMMARY OF THE INVENTION

The compositions of the present invention include novel isolated polypeptides, novel isolated polynucleotides encoding such polypeptides, including recombinant DNA molecules, cloned genes or degenerate variants thereof, especially naturally occurring variants such as allelic variants, antisense polynucleotide molecules, and antibodies that specifically recognize one or more epitopes present on such polypeptides, as well as hybridomas producing such antibodies.

The compositions of the present invention additionally include vectors, including expression vectors, containing the polynucleotides of the invention, cells genetically engineered to contain such polynucleotides and cells genetically engineered to express such polynucleotides.

The present invention relates to a collection or library of at least one novel nucleic acid sequence assembled from expressed sequence tags (ESTs) isolated mainly by sequencing by hybridization (SBM), and in some cases, sequences obtained from one or more public databases. The invention relates also to the proteins encoded by such polynucleotides, along with therapeutic, diagnostic and research utilities for these polynucleotides and proteins. These nucleic acid sequences are designated as SEQ ID NO: 1–948 and are provided in the Sequence Listing. In the nucleic acids provided in the Sequence Listing, A is adenine; C is cytosine; G is guanine; T is thymine; and N is any of the four bases. In the amino acids provided in the Sequence Listing, * corresponds to the stop codon.

The nucleic acid sequences of the present invention also include, nucleic acid sequences that hybridize to the complement of SEQ ID NO: 1–948 under stringent hybridization conditions; nucleic acid sequences which are allelic variants or species homologues of any of the nucleic acid sequences recited above, or nucleic acid sequences that encode a peptide comprising a specific domain or truncation of the peptides encoded by SEQ ID NO: 1–948. A polynucleotide comprising a nucleotide sequence having at least 90% identity to an identifying sequence of SEQ ID NO: 1–948 or a degenerate variant or fragment thereof. The identifying sequence can be 100 base pairs in length.

The nucleic acid sequences of the present invention also include the sequence information from the nucleic acid sequences of SEQ ID NO: 1–948. The sequence information can be a segment of any one of SEQ ID NO: 1–948 that uniquely identifies or represents the sequence information of SEQ ID NO: 1–948.

A collection as used in this application can be a collection of only one polynucleotide. The collection of sequence information or identifying information of each sequence can be provided on a nucleic acid array. In one embodiment, segments of sequence information is provided on a nucleic acid array to detect the polynucleotide that contains the segment. The array can be designed to detect full-match or mismatch to the polynucleotide that contains the segment. The collection can also be provided in a computer-readable format.

This invention also includes the reverse or direct complement of any of the nucleic acid sequences recited above; cloning or expression vectors containing the nucleic acid sequences; and host cells or organisms transformed with these expression vectors. Nucleic acid sequences (or their reverse or direct complements) according to the invention have numerous applications in a variety of techniques known to those skilled in the art of molecular biology, such as use as hybridization probes, use as primers for PCR, use in an array, use in computer-readable media, use in sequencing full-length genes, use for chromosome and gene mapping, use in the recombinant production of protein, and use in the generation of anti-sense DNA or RNA, their chemical analogs and the like.

In a preferred embodiment, the nucleic acid sequences of SEQ ID NO: 1–948 or novel segments or parts of the nucleic acids of the invention are used as primers in expression assays that are well known in the art. In a particularly preferred embodiment, the nucleic acid sequences of SEQ ID NO: 1–948 or novel segments or parts of the nucleic acids provided herein are used in diagnostics for identifying expressed genes or, as well known in the art and exemplified by Vollrath et al., Science 258:52–59 (1992), as expressed sequence tags for physical mapping of the human genome.

The isolated polynucleotides of the invention include, but are not limited to, a polynucleotide comprising any one of the nucleotide sequences set forth in SEQ ID NO: 1–948; a polynucleotide comprising any of the full length protein coding sequences of SEQ ID NO: 1–948; and a polynucleotide comprising any of the nucleotide sequences of the mature protein coding sequences of SEQ ID NO: 1–948. The polynucleotides of the present invention also include, but are not limited to, a polynucleotide that hybridizes under stringent hybridization conditions to (a) the complement of any one of the nucleotide sequences set forth in SEQ ID NO:

1–948; (b) a nucleotide sequence encoding any one of the amino acid sequences set forth in the Sequence Listing; (c) a polynucleotide which is an allelic variant of any polynucleotides recited above; (d) a polynucleotide which encodes a species homolog (e.g. orthologs) of any of the proteins recited above; or (e) a polynucleotide that encodes a polypeptide comprising a specific domain or truncation of any of the polypeptides comprising an amino acid sequence set forth in the Sequence Listing.

The isolated polypeptides of the invention include, but are not limited to, a polypeptide comprising any of the amino acid sequences set forth in the Sequence Listing; or the corresponding full length or mature protein. Polypeptides of the invention also include polypeptides with biological activity that are encoded by (a) any of the polynucleotides having a nucleotide sequence set forth in SEQ ID NO: 1–948; or (b) polynucleotides that hybridize to the complement of the polynucleotides of (a) under stringent hybridization conditions. Biologically or immunologically active variants of any of the polypeptide sequences in the Sequence Listing, and "substantial equivalents" thereof (e.g., with at least about 65%, 70%, 75%, 80%, 85%, 90%, 95%, 98% or 99% amino acid sequence identity) that preferably retain biological activity are also contemplated. The polypeptides of the invention may be wholly or partially chemically synthesized but are preferably produced by recombinant means using the genetically engineered cells (e.g. host cells) of the invention.

The invention also provides compositions comprising a polypeptide of the invention. Polypeptide compositions of the invention may further comprise an acceptable carrier, such as a hydrophilic, e.g., pharmaceutically acceptable, carrier.

The invention also provides host cells transformed or transfected with a polynucleotide of the invention.

The invention also relates to methods for producing a polypeptide of the invention comprising growing a culture of the host cells of the invention in a suitable culture medium under conditions permitting expression of the desired polypeptide, and purifying the polypeptide from the culture or from the host cells. Preferred embodiments include those in which the protein produced by such process is a mature form of the protein.

Polynucleotides according to the invention have numerous applications in a variety of techniques known to those skilled in the art of molecular biology. These techniques include use as hybridization probes, use as oligomers, or primers, for PCR, use for chromosome and gene mapping, use in the recombinant production of protein, and use in generation of anti-sense DNA or RNA, their chemical analogs and the like. For example, when the expression of an mRNA is largely restricted to a particular cell or tissue type, polynucleotides of the invention can be used as hybridization probes to detect the presence of the particular cell or tissue mRNA in a sample using, e.g., in situ hybridization.

In other exemplary embodiments, the polynucleotides are used in diagnostics as expressed sequence tags for identifying expressed genes or, as well known in the art and exemplified by Vollrath et al., Science 258:52–59 (1992), as expressed sequence tags for physical mapping of the human genome.

The polypeptides according to the invention can be used in a variety of conventional procedures and methods that are currently applied to other proteins. For example, a polypeptide of the invention can be used to generate an antibody that specifically binds the polypeptide. Such antibodies, particularly monoclonal antibodies, are useful for detecting or quantitating the polypeptide in tissue. The polypeptides of the invention can also be used as molecular weight markers, and as a food supplement.

Methods are also provided for preventing, treating, or ameliorating a medical condition which comprises the step of administering to a mammalian subject a therapeutically effective amount of a composition comprising a polypeptide of the present invention and a pharmaceutically acceptable carrier.

In particular, the polypeptides and polynucleotides of the invention can be utilized, for example, in methods for the prevention and/or treatment of disorders involving aberrant protein expression or biological activity.

The present invention further relates to methods for detecting the presence of the polynucleotides or polypeptides of the invention in a sample. Such methods can, for example, be utilized as part of prognostic and diagnostic evaluation of disorders as recited herein and for the identification of subjects exhibiting a predisposition to such conditions. The invention provides a method for detecting the polynucleotides of the invention in a sample, comprising contacting the sample with a compound that binds to and forms a complex with the polynucleotide of interest for a period sufficient to form the complex and under conditions sufficient to form a complex and detecting the complex such that if a complex is detected, the polynucleotide of interest is detected. The invention also provides a method for detecting the polypeptides of the invention in a sample comprising contacting the sample with a compound that binds to and forms a complex with the polypeptide under conditions and for a period sufficient to form the complex and detecting the formation of the complex such that if a complex is formed, the polypeptide is detected.

The invention also provides kits comprising polynucleotide probes and/or monoclonal antibodies, and optionally quantitative standards, for carrying out methods of the invention. Furthermore, the invention provides methods for evaluating the efficacy of drugs, and monitoring the progress of patients, involved in clinical trials for the treatment of disorders as recited above.

The invention also provides methods for the identification of compounds that modulate (i.e., increase or decrease) the expression or activity of the polynucleotides and/or polypeptides of the invention. Such methods can be utilized, for example, for the identification of compounds that can ameliorate symptoms of disorders as recited herein. Such methods can include, but are not limited to, assays for identifying compounds and other substances that interact with (e.g., bind to) the polypeptides of the invention. The invention provides a method for identifying a compound that binds to the polypeptides of the invention comprising contacting the compound with a polypeptide of the invention in a cell for a time sufficient to form a polypeptide/compound complex, wherein the complex drives expression of a reporter gene sequence in the cell; and detecting the complex by detecting the reporter gene sequence expression such that if expression of the reporter gene is detected the compound the binds to a polypeptide of the invention is identified.

The methods of the invention also provides methods for treatment which involve the administration of the polynucleotides or polypeptides of the invention to individuals exhibiting symptoms or tendencies. In addition, the invention encompasses methods for treating diseases or disorders as recited herein comprising administering compounds and other substances that modulate the overall activity of the target gene products. Compounds and other substances can effect such modulation either on the level of target gene/protein expression or target protein activity.

The polypeptides of the present invention and the polynucleotides encoding them are also useful for the same functions known to one of skill in the art as the polypeptides and polynucleotides to which they have homology (set forth in Table 2); for which they have a signature region (as set forth in Table 3); or for which they have homology to a gene family (as set forth in Table 4). If no homology is set forth for a sequence, then the polypeptides and polynucleotides of the present invention are useful for a variety of applications, as described herein, including use in arrays for detection.

3. DETAILED DESCRIPTION OF THE INVENTION

3.1 Definitions

It must be noted that as used herein and in the appended claims, the singular forms "a", "an" and "the" include plural references unless the context clearly dictates otherwise.

The term "active" refers to those forms of the polypeptide which retain the biologic and/or immunologic activities of any naturally occurring polypeptide. According to the invention, the terms "biologically active" or "biological activity" refer to a protein or peptide having structural, regulatory or biochemical functions of a naturally occurring molecule. Likewise "immunologically active" or "immunological activity" refers to the capability of the natural, recombinant or synthetic polypeptide to induce a specific immune response in appropriate animals or cells and to bind with specific antibodies.

The term "activated cells" as used in this application are those cells which are engaged in extracellular or intracellular membrane trafficking, including the export of secretory or enzymatic molecules as part of a normal or disease process.

The terms "complementary" or "complementarity" refer to the natural binding of polynucleotides by base pairing. For example, the sequence 5'-AGT-3' binds to the complementary sequence 3'-TCA-5'. Complementarity between two single-stranded molecules may be "partial" such that only some of the nucleic acids bind or it may be "complete" such that total complementarity exists between the single stranded molecules. The degree of complementarity between the nucleic acid strands has significant effects on the efficiency and strength of the hybridization between the nucleic acid strands.

The term "embryonic stem cells (ES)" refers to a cell that can give rise to many differentiated cell types in an embryo or an adult, including the germ cells. The term "germ line stem cells (GSCs)" refers to stem cells derived from primordial stem cells that provide a steady and continuous source of germ cells for the production of gametes. The term "primordial germ cells (PGCs)" refers to a small population of cells set aside from other cell lineages particularly from the yolk sac, mesenteries, or gonadal ridges during embryogenesis that have the potential to differentiate into germ cells and other cells. PGCs are the source from which GSCs and ES cells are derived The PGCs, the GSCs and the ES cells are capable of self-renewal. Thus these cells not only populate the germ line and give rise to a plurality of terminally differentiated cells that comprise the adult specialized organs, but are able to regenerate themselves.

The term "expression modulating fragment," EMF, means a series of nucleotides which modulates the expression of an operably linked ORF or another EMF.

As used herein, a sequence is said to "modulate the expression of an operably linked sequence" when the expression of the sequence is altered by the presence of the EMF. EMFs include, but are not limited to, promoters, and promoter modulating sequences (inducible elements). One class of EMFs are nucleic acid fragments which induce the expression of an operably linked ORF in response to a specific regulatory factor or physiological event.

The terms "nucleotide sequence" or "nucleic acid" or "polynucleotide" or "oligonculeotide" are used interchangeably and refer to a heteropolymer of nucleotides or the sequence of these nucleotides. These phrases also refer to DNA or RNA of genomic or synthetic origin which may be single-stranded or double-stranded and may represent the sense or the antisense strand, to peptide nucleic acid (PNA) or to any DNA-like or RNA-like material. In the sequences herein A is adenine, C is cytosine, T is thymine, G is guanine and N is A, C, G or T (U). It is contemplated that where the polynucleotide is RNA, the T (thymine) in the sequences provided herein is substituted with U (uracil). Generally, nucleic acid segments provided by this invention may be assembled from fragments of the genome and short oligonucleotide linkers, or from a series of oligonucleotides, or from individual nucleotides, to provide a synthetic nucleic acid which is capable of being expressed in a recombinant transcriptional unit comprising regulatory elements derived from a microbial or viral operon, or a eukaryotic gene.

The terms "oligonucleotide fragment" or a "polynucleotide fragment", "portion," or "segment" or "probe" or "primer" are used interchangeably and refer to a sequence of nucleotide residues which are at least about 5 nucleotides, more preferably at least about 7 nucleotides, more preferably at least about 9 nucleotides, more preferably at least about 11 nucleotides and most preferably at least about 17 nucleotides. The fragment is preferably less than about 500 nucleotides, preferably less than about 200 nucleotides, more preferably less than about 100 nucleotides, more preferably less than about 50 nucleotides and most preferably less than 30 nucleotides. Preferably the probe is from about 6 nucleotides to about 200 nucleotides, preferably from about 15 to about 50 nucleotides, more preferably from about 17 to 30 nucleotides and most preferably from about 20 to 25 nucleotides. Preferably the fragments can be used in polymerase chain reaction (PCR), various hybridization procedures or microarray procedures to identify or amplify identical or related parts of mRNA or DNA molecules. A fragment or segment may uniquely identify each polynucteotide sequence of the present invention. Preferably the fragment comprises a sequence substantially similar to any one of SEQ ID NOs: 1–948.

Probes may, for example, be used to determine whether specific mRNA molecules are present in a cell or tissue or to isolate similar nucleic acid sequences from chromosomal DNA as described by Walsh et al. (Walsh, P. S. et al., 1992, PCR Methods Appl 1:241–250). They may be labeled by nick translation, Klenow fill-in reaction, PCR, or other methods well known in the art. Probes of the present invention, their preparation and/or labeling are elaborated in Sambrook, J. et al., 1989, Molecular Cloning: A Laboratory Manual, Cold Spring Harbor Laboratory, NY; or Ausubel, F. M. et al., 1989, Current Protocols in Molecular Biology, John Wiley & Sons, New York N.Y., both of which are incorporated herein by reference in their entirety.

The nucleic acid sequences of the present invention also include the sequence information from the nucleic acid sequences of SEQ ID NOs: 1–948. The sequence information can be a segment of any one of SEQ ID NOs: 1–948 that uniquely identifies or represents the sequence information of that sequence of SEQ ID NO: 1–948. One such segment can be a twenty-mer nucleic acid sequence because the probability that a twenty-mer is fully matched in the human genome is 1 in 300. In the human genome, there are three billion base pairs in one set of chromosomes. Because $4^{20}$ possible twenty-mers exist, there are 300 times more twenty-mers than there are base pairs in a set of human chromosomes. Using the same analysis, the probability for a seventeen-mer to be fully matched in the human genome is approximately 1 in 5. When these segments are used in arrays for expression studies, fifteen-mer segments can be used. The probability that the fifteen-mer is fully matched in the expressed sequences is also approximately one in five because expressed sequences comprise less than approximately 5% of the entire genome sequence.

Similarly, when using sequence information for detecting a single mismatch, a segment can be a twenty-five mer. The probability that the twenty-five mer would appear in a human genome with a single mismatch is calculated by multiplying the probability for a full match $(1 \div 4^{25})$ times the increased probability for mismatch at each nucleotide position $(3 \times 25)$. The probability that an eighteen mer with a single mismatch can be detected in an array for expression studies is approximately one in five. The probability that a twenty-mer with a single mismatch can be detected in a human genome is approximately one in five.

The term "open reading frame," ORF, means a series of nucleotide triplets coding for amino acids without any termination codons and is a sequence translatable into protein.

The terms "operably linked" or "operably associated" refer to functionally related nucleic acid sequences. For example, a promoter is operably associated or operably linked with a coding sequence if the promoter controls the transcription of the coding sequence. While operably linked nucleic acid sequences can be contiguous and in the same reading friame, certain genetic elements e.g. repressor genes are not contiguously linked to the coding sequence but still control transcription/translation of the coding sequence.

The term "pluripotent" refers to the capability of a cell to differentiate into a number of differentiated cell types that are present in an adult organism. A pluripotent cell is restricted in its differentiation capability in comparison to a totipotent cell.

The terms "polypeptide" or "peptide" or "amino acid sequence" refer to an oligopeptide, peptide, polypeptide or protein sequence or fragment thereof and to naturally occurring or synthetic molecules. A polypeptide "fragment," "portion," or "segment" is a stretch of amino acid residues of at least about 5 amino acids, preferably at least about 7 amino acids, more preferably at least about 9 amino acids and most preferably at least about 17 or more amino acids. The peptide preferably is not greater than about 200 amino acids, more preferably less than 150 amino acids and most preferably less than 100 amino acids. Preferably the peptide is from about 5 to about 200 amino acids. To be active, any polypeptide must have sufficient length to display biological and/or immunological activity.

The term "naturally occurring polypeptide" refers to polypeptides produced by cells that have not been genetically engineered and specifically contemplates various polypeptides arising from post-translational modifications of the polypeptide including, but not limited to, acetylation, carboxylation, glycosylation, phosphorylation, lipidation and acylation.

The term "translated protein coding portion" means a sequence which encodes for the full length protein which may include any leader sequence or any processing sequence.

The term "mature protein coding sequence" means a sequence which encodes a peptide or protein without a signal or leader sequence. The "mature protein portion" means that portion of the protein which does not include a signal or leader sequence. The peptide may have been produced by processing in the cell which removes any leader/signal sequence. The mature protein portion may or may not include the initial methionine residue. The methionine residue may be removed from the protein during processing in the cell. The peptide may be produced synthetically or the protein may have been produced using a polynucleotide only encoding for the mature protein coding sequence.

The term "derivative" refers to polypeptides chemically modified by such techniques as ubiquitination, labeling (e.g., with radionuclides or various enzymes), covalent polymer attachment such as pegylation (derivatization with polyethylene glycol) and insertion or substitution by chemical synthesis of amino acids such as ornithine, which do not normally occur in human proteins.

The term "variant" (or "analog") refers to any polypeptide differing from naturally occurring polypeptides by amino acid insertions, deletions, and substitutions, created using, e g.; recombinant DNA techniques. Guidance in determining which amino acid residues may be replaced, added or deleted without abolishing activities of interest, may be found by comparing the sequence of the particular polypeptide with that of homologous peptides and minimizing the number of amino acid sequence changes made in regions of high homology (conserved regions) or by replacing amino acids with consensus sequence.

Alternatively, recombinant variants encoding these same or similar polypeptides may be synthesized or selected by making use of the "redundancy" in the genetic code. Various codon substitutions, such as the silent changes which produce various restriction sites, may be introduced to optimize cloning into a plasmid or viral vector or expression in a particular prokaryotic or eukaryotic system. Mutations in the polynucleotide sequence may be reflected in the polypeptide or domains of other peptides added to the polypeptide to modify the properties of any part of the polypeptide, to change characteristics such as ligand-binding affinities, interchain affinities, or degradation/turnover rate.

Preferably, amino acid "substitutions" are the result of replacing one amino acid with another amino acid having similar structural and/or chemical properties, i.e., conservative amino acid replacements. "Conservative" amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Insertions" or "deletions" are preferably in the range of about 1 to 20 amino acids, more preferably 1 to 10 amino acids. The variation allowed may be experimentally determined by systematically malking insertions, deletions, or substitutions of amino acids in a polypeptide molecule using recombinant DNA techniques and assaying the resulting recombinant variants for activity.

Alternatively, where alteration of function is desired, insertions, deletions or non-conservative alterations can be engineered to produce altered polypeptides. Such alterations can, for example, alter one or more of the biological functions or biochemical characteristics of the polypeptides of the invention. For example, such alterations may change polypeptide characteristics such as ligand-binding affinities, interchain affinities, or degradation/turnover rate. Further, such alterations can be selected so as to generate polypeptides that are better suited for expression, scale up and the like in the host cells chosen for expression. For example, cysteine residues can be deleted or substituted with another amino acid residue in order to eliminate disulfide bridges.

The terms "purified" or "substantially purified" as used herein denotes that the indicated nucleic acid or polypeptide is present in the substantial absence of other biological macromolecules, e.g., polynucleotides, proteins, and the like. In one embodiment, the polynucleotide or polypeptide is purified such that it constitutes at least 95% by weight, more preferably at least 99% by weight, of the indicated biological macromolecules present (but water, buffers, and other small molecules, especially molecules having a molecular weight of less than 1000 daltons, can be present).

The term "isolated" as used herein refers to a nucleic acid or polypeptide separated from at least one other component (e.g., nucleic acid or polypeptide) present with the nucleic acid or polypeptide in its natural source. In one embodiment, the nucleic acid or polypeptide is found in the presence of (if anything) only a solvent, buffer, ion, or other component normally present in a solution of the same. The terms "isolated" and "purified" do not encompass nucleic acids or polypeptides present in their natural source.

The term "recombinant," when used herein to refer to a polypeptide or protein, means that a polypeptide or protein is derived from recombinant (e.g., microbial, insect, or mammalian) expression systems. "Microbial" refers to recombinant polypeptides or proteins made in bacterial or fungal (e.g., yeast) expression systems. As a product, "recombinant microbial" defines a polypeptide or protein essentially free of native endogenous substances and unaccompanied by associated native glycosylation. Polypeptides or proteins expressed in most bacterial cultures, e.g., *E. coli*, will be free of glycosylation modifications; polypeptides or proteins expressed in yeast will have a glycosylation pattern in general different from those expressed in mammalian cells.

The term "recombinant expression vehicle or vector" refers to a plasmid or phage or virus or vector, for expressing a polypeptide from a DNA (RNA) sequence. An expression vehicle can comprise a transcriptional unit comprising an assembly of (1) a genetic element or elements having a regulatory role in gene expression, for example, promoters or enhancers, (2) a structural or coding sequence which is transcribed into mRNA and translated into protein, and (3) appropriate transcription initiation and termiination sequences. Structural units intended for use in yeast or eukaryotic expression systems preferably include a leader sequence enabling extracellular secretion of translated protein by a host cell. Alternatively, where recombinant protein is expressed without a leader or transport sequence, it may include an amino terminal methionine residue. This residue may or may not be subsequently cleaved from the expressed recombinant protein to provide a final product.

The term "recombinant expression system" means host cells which have stably integrated a recombinant transcriptional unit into chromosomal DNA or carry the recombinant transcriptional unit extrachromosomally. Recombinant expression systems as defined herein will express heterologous polypeptides or proteins upon induction of the regulatory elements linked to the DNA segment or synthetic gene to be expressed. This term also means host cells which have stably integrated a recombinant genetic element or elements having a regulatory role in gene expression, for example, promoters or enhancers. Recombinant expression systems as defined herein will express polypeptides or proteins endogenous to the cell upon induction of the regulatory elements linked to the endogenous DNA segment or gene to be expressed. The cells can be prokaryotic or eukaryotic.

The term "secreted" includes a protein that is transported across or through a membrane, including transport as a result of signal sequences in its amino acid sequence when it is expressed in a suitable host cell. "Secreted" proteins include without limitation proteins secreted wholly (e.g., soluble proteins) or partially (e.g., receptors) from the cell in which they are expressed. "Secreted" proteins also include without limitation proteins that are transported across the membrane of the endoplasmic reticulum. "Secreted" proteins are also intended to include proteins containing non-typical signal sequences (e.g. Interleukin-1 Beta, see Krasney, P. A. and Young, P. R. (1992) Cytokine 4(2):134–143) and factors released from damaged cells (e.g. Interleukin-1 Receptor Antagonist, see Arend, W. P. et. al. (1998) Annu. Rev. Immunol. 16:27–55)

Where desired, an expression vector may be designed to contain a "signal or leader sequence" which will direct the polypeptide through the membrane of a cell. Such a sequence may be naturally present on the polypeptides of the present invention or provided from heterologous protein sources by recombinant DNA techniques.

The term "stringent" is used to refer to conditions that are commonly understood in the art as stringent. Stringent conditions can include highly stringent conditions (i.e., hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C.), and moderately stringent conditions (i.e., washing in 0.2×SSC/0.1% SDS at 42° C.). Other exemplary hybridization conditions are described herein in the examples.

In instances of hybridization of deoxyoligonucleotides, additional exemplary stringent hybridization conditions include washing in 6×SSC/0.05% sodium pyrophosphate at 37° C. (for 14-base oligonucleotides), 48° C. (for 17-base oligos), 55° C. (for 20-base oligonucleotides), and 60° C. (for 23-base oligonucleotides).

As used herein, "substantially equivalent" or "substantially similar" can refer both to nucleotide and amino acid sequences, for example a mutant sequence, that varies from a reference sequence by one or more substitutions, deletions, or additions, the net effect of which does not result in an adverse functional dissimilarity between the reference and subject sequences. Typically, such a substantially equivalent sequence varies from one of those listed herein by no more than about 35% (i.e., the number of individual residue substitutions, additions, and/or deletions in a substantially equivalent sequence, as compared to the corresponding reference sequence, divided by the total number of residues in the substantially equivalent sequence is about 0.35 or less). Such a sequence is said to have 65% sequence identity to the listed sequence. In one embodiment, a substantially equivalent, e.g., mutant, sequence of the invention varies from a listed sequence by no more than 30% (70% sequence identity); in a variation of this embodiment, by no more than 25% (75% sequence identity); and in a further variation of this embodiment, by no more than 20% (80% sequence identity) and in a further variation of this embodiment, by no more than 10% (90% sequence identity) and in a further variation of this embodiment, by no more that 5% (95% sequence identity). Substantially equivalent, e.g., mutant, amino acid sequences according to the invention preferably have at least 80% sequence identity with a listed amino acid sequence, more preferably at least 85% sequence identity, more preferably at least 90% sequence identity, more preferably at least 95% sequence identity, more preferably at least 98% sequence identity, and most preferably at least 99% sequence identity. Substantially equivalent nucleotide sequence of the invention can have lower percent sequence identities, taking into account, for example, the redundancy or degeneracy of the genetic code. Preferably, the nucleotide sequence has at least about 65% identity, more preferably at least about 75% identity, more preferably at least about 80% sequence identity, more preferably at least 85% sequence identity, more preferably at least 90% sequence identity, more preferably at least about 95% sequence identity, more preferably at least 98% sequence identity, and most preferably at least 99% sequence identity. For the purposes of the present invention, sequences having substantially equivalent biological activity and substantially equivalent expression characteristics are considered substantially equivalent. For the purposes of determining equivalence, truncation of the mature sequence (e.g., via a mutation which creates a spurious stop codon) should be disregarded. Sequence identity may be determined, e.g., using the Jotun Hein method (Hein, J. (1990) Methods Enzymol. 183:626–645). Identity between sequences can also be determined by other methods known in the art, e.g. by varying hybridization conditions.

The term "totipotent" refers to the capability of a cell to differentiate into all of the cell types of an adult organism.

The term "transformation" means introducing DNA into a suitable host cell so that the DNA is replicable, either as an extrachromosomal element, or by chromosomal integration. The term "transfection" refers to the taking up of an expression vector by a suitable host cell, whether or not any coding sequences are in fact expressed. The term "infection" refers to the introduction of nucleic acids into a suitable host cell by use of a virus or viral vector.

As used herein, an "uptake modulating fragment," UMF, means a series of nucleotides which mediate the uptake of a linked DNA fragment into a cell. UMFs can be readily identified using known UMFs as a target sequence or target motif with the computer-based systems described below. The presence and activity of a UMF can be confirmed by attaching the suspected UMF to a marker sequence. The resulting nucleic acid molecule is then incubated with an appropriate host under appropriate conditions and the uptake of the marker sequence is determined. As described above, a UMF will increase the frequency of uptake of a linked marker sequence.

Each of the above terms is meant to encompass all that is described for each, unless the context dictates otherwise.

3.2 Nucleic Acids of the Invention

Nucleotide sequences of the invention are set forth in the Sequence Listing.

The isolated polynucleotides of the invention include a polynucleotide comprising the nucleotide sequences of SEQ ID NO: 1–948; a polynucleotide encoding any one of the peptide sequences of SEQ ID NO: 1–948; and a polynucleotide comprising the nucleotide sequence encoding the mature protein coding sequence of the polynucleotides of any one of SEQ ID NO: 1–948. The polynucleotides of the present invention also include, but are not limited to, a polynucleotide that hybridizes under stringent conditions to (a) the complement of any of the nucleotides sequences of SEQ ID NO: 1–948; (b) nucleotide sequences encoding any one of the amino acid sequences set forth in the Sequence Listing; (c) a polynucleotide which is an allelic variant of any polynucleotide recited above; (d) a polynucleotide which encodes a species homolog of any of the proteins recited above; or (e) a polynucleotide that encodes a polypeptide comprising a specific domain or truncation of the polypeptides of SEQ ID NO: 1–948. Domains of interest may depend on the nature of the encoded polypeptide; e.g., domains in receptor-like polypeptides include ligand-binding, extracellular, transmembrane, or cytoplasmic domains, or combinations thereof; domains in immunoglobulin-like proteins include the variable immunoglobulin-like domains; domains in enzyme-like polypeptides include catalytic and substrate binding domains; and domains in ligand polypeptides include receptor-binding domains.

The polynucleotides of the invention include naturally occurring or wholly or partially synthetic DNA, e.g., cDNA and genomic DNA, and RNA, e.g., mRNA. The polynucleotides may include all of the coding region of the cDNA or may represent a portion of the coding region of the cDNA.

The present invention also provides genes corresponding to the cDNA sequences disclosed herein. The corresponding genes can be isolated in accordance with known methods using the sequence information disclosed herein Such methods include the preparation of probes or primers from the disclosed sequence information for identification and/or amplification of genes in appropriate genomic libraries or other sources of genomic materials. Further 5' and 3' sequence can be obtained using methods known in the art. For example, full length cDNA or genomic DNA that corresponds to any of the polynucleotides of SEQ ID NO: 1–948 can be obtained by screening appropriate cDNA or genomic DNA libraries under suitable hybridization conditions using any of the polynucleotides of SEQ ID NO: 1–948 or a portion thereof as a probe. Alternatively, the polynucleotides of SEQ ID NO: 1–948 may be used as the basis for suitable primer(s) that allow identification and/or amplification of genes in appropriate genomic DNA or cDNA libraries.

The nucleic acid sequences of the invention can be assembled from ESTs and sequences (including cDNA and genomic sequences) obtained from one or more public databases, such as dbEST, gbpri, and UniGene. The EST sequences can provide identifying sequence information, representative fragment or segment information, or novel segment information for the full-length gene.

The polynucleotides of the invention also provide polynucleotides including nucleotide sequences that are substantially equivalent to the polynucleotides recited above. Polynucleotides according to the invention can have, e.g., at least about 65%, at least about 70%, at least about 75%, at least about 80%, 81%, 82%, 83%, 84%, more typically at least about 85%, 86%, 87%, 88%, 89%, more typically at least about 90%, 91%, 92%, 93%, 94%, and even more typically at least about 95%, 96%, 97%, 98%, 99% sequence identity to a polynucleotide recited above.

Included within the scope of the nucleic acid sequences of the invention are nucleic acid sequence fragments that hybridize under stringent conditions to any of the nucleotide sequences of SEQ ID NO: 1–948, or complements thereof, which fragment is greater than about 5 nucleotides, preferably 7 nucleotides, more preferably greater than 9 nucleotides and most preferably greater than 17 nucleotides. Fragments of, e.g. 15, 17, or 20 nucleotides or more that are selective for (i.e. specifically hybridize to any one of the polynucleotides of the invention) are contemplated. Probes capable of specifically hybridizing to a polynucleotide can differentiate polynucleotide sequences of the invention from other polynucleotide sequences in the same family of genes or can differentiate human genes from genes of other species, and are preferably based on unique nucleotide sequences.

The sequences falling within the scope of the present invention are not limited to these specific sequences, but also include allelic and species variations thereof. Allelic and species variations can be routinely determined by comparing the sequence provided in SEQ ID NO: 1–948, a representative fragment thereof, or a nucleotide sequence at least 90% identical, preferably 95% identical, to SEQ ID NOs: 1–948 with a sequence from another isolate of the same species. Furthermore, to accommodate codon variability, the invention includes nucleic acid molecules coding for the same amino acid sequences as do the specific ORFs disclosed herein. In other words, in the coding region of an ORF, substitution of one codon for another codon that encodes the same amino acid is expressly contemplated.

The nearest neighbor or homology result for the nucleic acids of the present invention, including SEQ ID NOs: 1–948, can be obtained by searching a database using an algorithm or a program. Preferably, a BLAST which stands for Basic Local Alignment Search Tool is used to search for local sequence alignments (Altshul, S. F. J Mol. Evol. 36 290–300 (1993) and Altschul S. F. et al. J. Mol. Biol. 21:403–410 (1990)). Alternatively a FASTA version 3 search against Genpept, using Fastxy algorithm.

Species homologs (or orthologs) of the disclosed polynucleotides and proteins are also provided by the present invention. Species homologs may be isolated and identified by making suitable probes or primers from the sequences provided herein and screening a suitable nucleic acid source from the desired species.

The invention also encompasses allelic variants of the disclosed polynucleotides or proteins; that is, naturally-occurring alternative forms of the isolated polynucleotide which also encode proteins which are identical, homologous or related to that encoded by the polynucleotides.

The nucleic acid sequences of the invention are further directed to sequences which encode variants of the described nucleic acids. These amino acid sequence variants may be prepared by methods known in the art by introducing appropriate nucleotide changes into a native or variant polynucleotide. There are two variables in the construction of amino acid sequence variants: the location of the mutation and the nature of the mutation. Nucleic acids encoding the amino acid sequence variants are preferably constructed by mutating the polynucleotide to encode an amino acid sequence that does not occur in nature. These nucleic acid alterations can be made at sites that differ in the nucleic acids from different species (variable positions) or in highly conserved regions (constant regions). Sites at such locations will typically be modified in series, e.g., by substituting first with conservative choices (e.g., hydrophobic amino acid to a different hydrophobic amino acid) and then with more distant choices (e.g., hydrophobic amino acid to a charged amino acid), and then deletions or insertions may be made at the target site. Amino acid sequence deletions generally range from about 1 to 30 residues, preferably about 1 to 10 residues, and are typically contiguous. Amino acid insertions include amino- and/or carboxyl-terminal fusions ranging in length from one to one hundred or more residues, as well as intrasequence insertions of single or multiple amino acid residues. Intrasequence insertions may range generally from about 1 to 10 amino residues, preferably from 1 to 5 residues. Examples of terminal insertions include the heterologous signal sequences necessary for secretion or for intracellular targeting in different host cells and sequences such as FLAG or poly-histidine sequences useful for purifying the expressed protein.

In a preferred method, polynucleotides encoding the novel amino acid sequences are changed via site-directed mutagenesis. This method uses oligonucleotide sequences to alter a polynucleotide to encode the desired amino acid variant, as well as sufficient adjacent nucleotides on both sides of the changed amino acid to form a stable duplex on either side of the site of being changed. In general, the techniques of site-directed mutagenesis are well known to those of skill in the art and this technique is exemplified by publications such as, Edelman et al., *DNA* 2:183 (1983). A versatile and efficient method for producing site-specific changes in a polynucleotide sequence was published by Zoller and Smith, *Nucleic Acids Res.* 10:6487–6500 (1982). PCR may also be used to create amino acid sequence variants of the novel nucleic acids. When small amounts of template DNA are used as starting material, primer(s) that differs slightly in sequence from the corresponding region in the template DNA can generate the desired amino acid variant. PCR amplification results in a population of product DNA fragments that differ from the polynucleotide template encoding the polypeptide at the position specified by the primer. The product DNA fragments replace the corresponding region in the plasmid and this gives a polynucleotide encoding the desired amino acid variant.

A further technique for generating amino acid variants is the cassette mutagenesis technique described in Wells et al., *Gene* 34:315 (1985); and other mutagenesis techniques well known in the art, such as, for example, the techniques in Sambrook et al., supra, and *Current Protocols in Molecular Biology*, Ausubel et al. Due to the inherent degeneracy of the genetic code, other DNA sequences which encode substantially the same or a functionally equivalent amino acid sequence may be used in the practice of the invention for the cloning and expression of these novel nucleic acids. Such DNA sequences include those which are capable of hybridizing to the appropriate novel nucleic acid sequence under stringent conditions.

Polynucleotides encoding preferred polypeptide truncations of the invention can be used to generate polynucleotides encoding chimeric or fusion proteins comprising one or more domains of the invention and heterologous protein sequences.

The polynucleotides of the invention additionally include the complement of any of the polynucleotides recited above. The polynucleotide can be DNA (genomic, cDNA, amplified, or synthetic) or RNA. Methods and algorithms for obtaining such polynucleotides are well known to those of skill in the art and can include, for example, methods for determining hybridization conditions that can routinely isolate polynucleotides of the desired sequence identities.

In accordance with the invention, polynucleotide sequences comprising the mature protein coding sequences corresponding to any one of SEQ ID NO: 1–948, or functional equivalents thereof, may be used to generate recombinant DNA molecules that direct the expression of that nucleic acid, or a functional equivalent thereof, in appropriate host cells. Also included are the cDNA inserts of any of the clones identified herein.

A polynucleotide according to the invention can be joined to any of a variety of other nucleotide sequences by well-established recombinant DNA techniques (see Sambrook J et al. (1989) Molecular Cloning: A Laboratory Manual, Cold Spring Harbor Laboratory, NY). Useful nucleotide sequences for joining to polynucleotides include an assortment of vectors, e.g., plasmids, cosmids, lambda phage derivatives, phagemids, and the like, that are well known in the art. Accordingly, the invention also provides a vector including a polynucleotide of the invention and a host cell containing the polynucleotide. In general, the vector contains an origin of replication functional in at least one organism, convenient restriction endonuclease sites, and a selectable marker for the host cell. Vectors according to the invention include expression vectors, replication-vectors, probe generation vectors, and sequencing vectors. A host cell according to the invention can be a prokaryotic or eukaryotic cell and can be a unicellular organism or part of a multicellular organism.

The present invention further provides recombinant constructs comprising a nucleic acid having any of the nucleotide sequences of SEQ ID NOs: 1–948 or a fragment thereof or any other polynucleotides of the invention. In one embodiment, the recombinant constructs of the present invention comprise a vector, such as a plasmid or viral vector, into which a nucleic acid having any of the nucleotide sequences of SEQ ID NOs: 1–948 or a fragment thereof is inserted, in a forward or reverse orientation. In the case of a vector comprising one of the ORFs of the present invention, the vector may further comprise regulatory sequences, including for example, a promoter, operably linked to the ORF. Large numbers of suitable vectors and promoters are known to those of skill in the art and are commercially available for generating the recombinant constructs of the present invention. The following vectors are provided by way of example. Bacterial: pBs, phagescript, PsiX174, pBluescript SK, pBs KS, pNH8a, pNH16a, pNH18a, pNH46a (Stratagene); pTrc99A, pKK223-3, pKK233-3, pDR540, pRIT5 (Pharmacia). Eukaryotic: pWLneo, pSV2cat, pOG44, PXTI, pSG (Stratagene) pSVK3, pBPV, pMSG, pSVL (Pharmacia).

The isolated polynucleotide of the invention may be operably linked to an expression control sequence such as the pMT2 or pED expression vectors disclosed in Kaufmnan et al., Nucleic Acids Res. 19, 4485–4490 (1991), in order to produce the protein recombinantly. Many suitable expression control sequences are known in the art. General methods of expressing recombinant proteins are also known and are exemplified in R. Kaufman, Methods in Enzymology 185, 537–566 (1990). As defined herein "operably linked" means that the isolated polynucleotide of the invention and an expression control sequence are situated within a vector or cell in such a way that the protein is expressed by a host cell which has been transformed (transfected) with the ligated polynucleotide/expression control sequence.

Promoter regions can be selected from any desired gene using CAT (chloramphenicol transferase) vectors or other vectors with selectable markers. Two appropriate vectors are pKK232-8 and pCM7. Particular named bacterial promoters include lac, lacZ, T3, T7, gpt, lambda PR, and trc. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art. Generally, recombinant expression vectors will include origins of replication and selectable markers permitting transformation of the host cell, e.g., the ampicillin resistance gene of E. coli and S. cerevisiae TRP 1 gene, and a promoter derived from a highly-expressed gene to direct transcription of a downstream structural sequence. Such promoters can be derived from operons encoding glycolytic enzymes such as 3-phosphoglycerate kinase (PGK), a-factor, acid phosphatase, or heat shock proteins, among others. The heterologous structural sequence is assembled in appropriate phase with translation initiation and termination sequences, and preferably, a leader sequence capable of directing secretion of translated protein into the periplasmic space or extracellular medium. Optionally, the heterologous sequence can encode a fusion protein including an amino terminal identification peptide imparting desired characteristics, e.g., stabilization or simplified purification of expressed recombinant product. Useful expression vectors for bacterial use are constructed by inserting a structural DNA sequence encoding a desired protein together with suitable translation initiation and termination signals in operable reading phase with a functional promoter. The vector will comprise one or more phenotypic selectable markers and an origin of replication to ensure maintenance of the vector and to, if desirable, provide amplification within the host. Suitable prokaryotic hosts for transformation include E. coli, Bacillus subtilis, Salmonella typhimurium and various species within the genera Pseudomonas, Streptomyces, and Staphylococcus, although others may also be employed as a matter of choice.

As a representative but non-limiting example, usefull expression vectors for bacterial use can comprise a selectable marker and bacterial origin of replication derived from commercially available plasmids comprising genetic elements of the well known cloning vector pBR322 (ATCC 37017). Such commercial vectors include, for example, pKK223-3 (Pharmacia Fine Chemicals, Uppsala, Sweden) and GEM 1 (Promega Biotech, Madison, Wis., USA). These pBR322 "backbone" sections are combined with an appropriate promoter and the structural sequence to be expressed. Following transformation of a suitable host strain and growth of the host strain to an appropriate cell density, the selected promoter is induced or derepressed by appropriate means (e.g., temperature shift or chemical induction) and cells are cultured for an additional period. Cells are typically harvested by centrimugation, disrupted by physical or chemical means, and the resulting crude extract retained for further purification.

Polynucleotides of the invention can also be used to induce immune responses. For example, as described in Fan et al., Nat. Biotech. 17:870–872 (1999), incorporated herein by reference, nucleic acid sequences encoding a polypeptide may be used to generate antibodies against the encoded polypeptide following topical administration of naked plasmid DNA or following injection, and preferably intramuscular injection of the DNA. The nucleic acid sequences are preferably inserted in a recombinant expression vector and may be in the form of naked DNA.

3.3 Antisense

Another aspect of the invention pertains to isolated antisense nucleic acid molecules that are hybridizable to or complementary to the nucleic acid molecule comprising the nucleotide sequence of SEQ ID NO: 1–948, or fragments, analogs or derivatives thereof. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. In specific aspects, antisense nucleic acid molecules are provided that comprise a sequence complementary to at least about 10, 25, 50, 100, 250 or 500 nucleotides or an entire coding strand, or to only a portion thereof. Nucleic acid molecules encoding fragments, homologs, derivatives and analogs of a protein of any of SEQ ID NO: 1–948 or antisense nucleic acids complementary to a nucleic acid sequence of SEQ ID NO: 1–948 are additionally provided.

In one embodiment, an antisense nucleic acid molecule is antisense to a "coding region" of the coding strand of a nucleotide sequence of the invention. The term "coding region" refers to the region of the nucleotide sequence comprising codons which are translated into amino acid residues. In another embodiment, the antisense nucleic acid molecule is antisense to a "noncoding region" of the coding strand of a nucleotide sequence of the invention. The term "noncoding region" refers to 5' and 3' sequences that flank the coding region that are not translated into amino acids (i.e., also referred to as 5' and 3' untranslated regions).

Given the coding strand sequences encoding a nucleic acid disclosed herein (e.g., SEQ ID NO: 1–948, antisense nucleic acids of the invention can be designed according to the rules of Watson and Crick or Hoogsteen base pairing. The antisense nucleic acid molecule can be complementary to the entire coding region of an mRNA, but more preferably is an oligonucleotide that is antisense to only a portion of the coding or noncoding region of an mRNA. For example, the antisense oligonucleotide can be complementary to the region surrounding the translation start site of an mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleicacid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a protein according to the invention to thereby inhibit expression of the protein, e.g., by inhibiting transcription and/or translation. The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies that bind to cell surface receptors or antigens. The antisense nucleic acid molecules can also be delivered to cells using the vectors described herein. To achieve sufficient intracellular concentrations of antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual α-units, the strands run parallel to each other (Gaultier et al. (1987) *Nucleic Acids Res* 15: 6625–6641). The antisense nucleic acid molecule can also comprise a 2'-o-methylribonucleotide (Inoue et al. (1987) *Nucleic Acids Res* 15: 6131–6148) or a chimeric RNA-DNA analogue (Inoue et al. (1 987) *FEBS Lett* 215: 327–330).

3.4 Ribozymes and PNA Moieties

In still another embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585–591)) can be used to catalytically cleave mRNA transcripts to thereby inhibit translation of an mRNA. A ribozyme having specificity for a nucleic acid of the invention can be designed based upon the nucleotide sequence of a DNA disclosed herein (ie., SEQ ID NO: 1–948). For example, a derivative of Tetrahymena L-19 IVS RNA can be constructed in which the nucleotide sequence of the active site is complementary to the nucleotide sequence to be cleaved in a SECX-encoding mRNA. See, e.g., Cech et al. U.S. Pat. No. 4,987,071; and Cech et al. U.S. Pat. No. 5,116,742. Alternatively, SECX mRNA can be used to select a catalytic RNA having a specific ribonuclease activity from a pool of RNA molecules. See, e.g., Bartel et al., (1993) *Science* 261:1411–1418.

Alternatively, gene expression can be inhibited by targeting nucleotide sequences complementary to the regulatory region (e.g., promoter and/or enhancers) to form triple helical structures that prevent transcription of the gene in target cells. See generally, Helene. (1991) *Anticancer Drug Des*. 6: 569–84; Helene. et al. (1992) *Ann. N.Y. Acad. Sci*. 660:27–36; and Maher (1992) *Bioassays* 14: 807–15.

In various embodiments, the nucleic acids of the invention can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) *Bioorg Med Chem* 4: 5–23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996) above; Perry-O'Keefe et al. (1996) *PNAS* 93: 14670–675.

PNAs of the invention can be used in therapeutic and diagnostic applications. For example, PNAs can be used as antisense or antigene agents for sequence-specific modulation of gene expression by, e.g., inducing transcription or translation arrest or inhibiting replication. PNAs of the invention can also be used, e.g., in the analysis of single base pair mutations in a gene by, e.g., PNA directed PCR clamping; as artificial irestriction enzymes when used in combination with other enzymes, e.g., S1 nucleases (Hyrup B. (1996) above); or as probes or primers for DNA sequence and hybridization (Hyrup et al. (1996), above; Perry-O'Keefe (1996), above).

In another embodiment, PNAs of the invention can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated that may combine the advantageous properties of PNA and DNA. Such chimeras allow DNA recognition enzymes, e.g., RNase H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup (1996) above). The synthesis of PNA-DNA chimeras can be performed as described in Hyrup (1996) above and Finn et al. (1996) *Nucl Acids Res* 24: 3357–63. For example, a DNA chain can be synthesized on a solid support using standard phosphoramidite coupling chemistry, and modified nucleoside analogs, e.g., 5'(4-methoxytrityl)amino-5'-deoxy-thymidine phosphoramidite, can be used between the PNA and the 5' end of DNA (Mag et al. (1989) *Nucl Acid Res* 17: 5973–88). PNA monomers are then coupled in a stepwise manner to produce a chimeric molecule with a 5' PNA segment and a 3' DNA segment (Finn et al. (1996) above). Alternatively, chimeric molecules can be synthesized with a 5' DNA segment and a 3' PNA segment. See, Petersen et al. (1975) *Bioorg Med Chem Lett* 5: 1119–11124.

In other embodiments, the oligonucleotide may include other appended groups such as peptides (e.g., for targeting host cell receptors in vivo), or agents facilitating transport across the cell membrane (see, e.g., Letsinger et al., 1989, *Proc. Natl. Acad. Sci. U.S.A.* 86:6553–6556; Lemaitre et al., 1987, Proc. Natl. *Acad. Sci.* 84:648–652; PCT Publication No. W088/09810) or the blood-brain barrier (see, e.g., PCT Publication No. W089/10134). In addition, oligonucleotides can be modified with hybridization triggered cleavage agents (See, e.g., Krol et al., 1988, *BioTechniques* 6:958–976) or intercalating agents. (See, e.g., Zon, 1988, *Pharm. Res.* 5: 539–549). To this end, the oligonucleotide may be conjugated to another molecule, e.g., a peptide, a hybridization triggered cross-linking agent, a transport agent, a hybridization-triggered cleavage agent, etc.

3.5 Hosts

The present invention further provides host cells genetically engineered to contain the polynucleotides of the invention. For example, such host cells may contain nucleic acids of the invention introduced into the host cell using known transformation, transfection or infection methods. The present invention still further provides host cells genetically engineered to express the polynucleotides of the invention, wherein such polynucleotides are in operative association with a regulatory sequence heterologous to the host cell which drives expression of the polynucleotides in the cell.

Knowledge of nucleic acid sequences allows for modification of cells to permit, or increase, expression of endogenous polypeptide. Cells can be modified (e.g., by homologous recombination) to provide increased polypeptide expression by replacing, in whole or in part, the naturally occurring promoter with all or part of a heterologous promoter so that the cells express the polypeptide at higher levels. The heterologous promoter is inserted in such a manner that it is operatively linked to the encoding sequences. See, for example, PCT International Publication No. WO94/12650, PCT International Publication No. WO92/20808, and PCT International Publication No. WO91/09955. It is also contemplated that, in addition to heterologous promoter DNA, amplifiable marker DNA (e.g., ada, dhfr, and the multifunctional CAD gene which encodes carbamyl phosphate synthase, aspartate transcarbamylase, and dihydroorotase) and/or intron DNA may be inserted along with the heterologous promoter DNA. If linked to the coding sequence, amplification of the marker DNA by standard selection methods results in co-amplification of the desired protein coding sequences in the cells.

The host cell can be a higher eukaryotic host cell, such as a mammalian cell, a lower eukaryotic host cell, such as a yeast cell, or the host cell can be a prokaryotic cell, such as a bacterial cell. Introduction of the recombinant construct into the host cell can be effected by calcium phosphate transfection, DEAE, dextran mediated transfection, or electroporation Davis, L. et al., *Basic Methods in Molecular Biology* (1986)). The host cells containing one of the polynucleotides of the invention, can be used in conventional manners to produce the gene product encoded by the isolated fragment (in the case of an ORF) or can be used to produce a heterologous protein under the control of the EMF.

Any host/vector system can be used to express one or more of the ORFs of the present invention. These include, but are not limited to, eukaryotic hosts such as HeLa cells, Cv-1 cell, COS cells, 293 cells, and Sf9 cells, as well as prokaryotic host such as *E. coli* and *B. subtilis*. The most preferred cells are those which do not normally express the particular polypeptide or protein or which expresses the polypeptide or protein at low natural level. Mature proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al., in Molecular Cloning: A Laboratory Manual, Second Edition, Cold Spring Harbor, N.Y. (1989), the disclosure of which is hereby incorporated by reference.

Various mammalian cell culture systems can also be employed to express recombinant protein. Examples of mammalian expression systems include the COS-7 lines of monkey kidney fibroblasts, described by Gluzman, Cell 23:175 (1981). Other cell lines capable of expressing a compatible vector are, for example, the C127, monkey COS cells, Chinese Hamster Ovary (CHO) cells, human kidney 293 cells, human epidermal A431 cells, human Colo205 cells, 3T3 cells, CV-1 cells, other transformed primate cell lines, normal diploid cells, cell strains derived from in vitro culture of primary tissue, primary explants, HeLa cells, mouse L cells, BHK, HL60, U937, HaK or Jurkat cells. Mammalian expression vectors will comprise an origin of replication, a suitable promoter and also any necessary ribosome binding sites, polyadenylation site, splice donor and acceptor sites, transcriptional termination sequences, and 5' flanking nontranscribed sequences. DNA sequences derived from the SV40 viral genome, for example, SV40 origin, early promoter, enhancer, splice, and polyadenylation sites may be used to provide the required nontranscribed genetic elements. Recombinant polypeptides and proteins produced in bacterial culture are usually isolated by initial extraction from cell pellets, followed by one or more salting-out, aqueous ion exchange or size exclusion chromatography steps. Protein refolding steps can be used, as necessary, in completing configuration of the mature protein. Finally, high performance liquid chromatography (HPLC) can be employed for fmal purification steps. Microbial cells employed in expression of proteins can be disrupted by any convenient method, including freeze-thaw cycling, sonication, mechanical disruption, or use of cell lysing agents.

Alternatively, it may be possible to produce the protein in lower eukaryotes such as yeast or insects or in prokaryotes such as bacteria. Potentially suitable yeast strains include *Saccharomyces cerevisiae, Schizosaccharomyces pombe,* Kluyveromyces strains, Candida, or any yeast strain capable of expressing heterologous proteins. Potentially suitable bacterial strains include *Escherichia coli, Bacillus subtilis, Salmonella typhimurium,* or any bacterial strain capable of expressing heterologous proteins. If the protein is made in yeast or bacteria, it may be necessary to modify the protein produced therein, for example by phosphorylation or glycosylation of the appropriate sites, in order to obtain the functional protein. Such covalent attachments may be accomplished using known chemical or enzymatic methods.

In another embodiment of the present invention, cells and tissues may be engineered to express an endogenous gene comprising the polynucleotides of the invention under the control of inducible regulatory elements, in which case the regulatory sequences of the endogenous gene may be replaced by homologous recombination. As described herein, gene targeting can be used to replace a gene's existing regulatory region with a regulatory sequence isolated from a different gene or a novel regulatory sequence synthesized by genetic engineering methods. Such regulatory sequences may be comprised of promoters, enhancers, scaffold-attachment regions, negative regulatory elements, transcriptional initiation sites, regulatory protein binding sites or combinations of said sequences. Alternatively, sequences which affect the structure or stability of the RNA or protein produced may be replaced, removed, added, or otherwise modified by targeting. These sequence include polyadenylation signals, mRNA stability elements, splice sites, leader sequences for enhancing or modifying transport or secretion properties of the protein, or other sequences which alter or improve the fumction or stability of protein or RNA molecules.

The targeting event may be a simple insertion of the regulatory sequence, placing the gene under the control of the new regulatory sequence, e.g., inserting a new promoter or enhancer or both upstream of a gene. Alternatively, the targeting event may be a simple deletion of a regulatory element, such as the deletion of a tissue-specific negative regulatory element. Alternatively, the targeting event may replace an existing element; for example, a tissue-specific enhancer can be replaced by an enhancer that has broader or different cell-type specificity than the naturally occurring elements. Here, the naturally occurring sequences are deleted and new sequences are added. In all cases, the identification of the targeting event may be facilitated by the use of one or more selectable marker genes that are contiguous with the targeting DNA, allowing for the selection of cells in which the exogenous DNA has integrated into the host cell genome. The identification of the targeting event may also be facilitated by the use of one or more marker genes exhibiting the property of negative selection, such that the negatively selectable marker is linked to the exogenous DNA, but configured such that the negatively selectable marker flanks the targeting sequence, and such that a correct homologous recombination event with sequences in the host cell genome does not result in the stable integration of the negatively selectable marker. Markers useful for this purpose include the Herpes Simplex Virus thyrnidine kinase (TK) gene or the bacterial xanthine-guanine phosphoribosyl-transferase (gpt) gene.

The gene targeting or gene activation techniques which can be used in accordance with this aspect of the invention are more particularly described in U.S. Pat. No. 5,272,071 to Chappel; U.S. Pat. No. 5,578,461 to Sherwin et al.; International Application No. PCT/US92/09627 (WO93/09222) by Selden et al.; and International Application No. PCT/US90/06436 (WO91/06667) by Skoultchi et al., each of which is incorporated by reference herein in its entirety.

3.6 Polypeptides of the Invention

The isolated polypeptides of the invention include, but are not limited to, a polypeptide comprising: the amino acid sequences set forth as any one of SEQ ID NO: 1–948 or an amino acid sequence encoded by any one of the nucleotide sequences SEQ ID NOs: 1–948 or the corresponding fulll length or mature protein. Polypeptides of the invention also include polypeptides preferably with biological or immunological activity that are encoded by: (a) a polynucleotide having any one of the nucleotide sequences set forth in SEQ ID NOs: 1–948 or (b) polynucleotides encoding any one of the amino acid sequences set forth as SEQ ID NO: 1–948 or (c) polynucleotides that hybridize to the complement of the polynucleotides of either (a) or (b) under stringent hybridization conditions. The invention also provides biologically active or immunologically active variants of any of the amino acid sequences set forth as SEQ ID NO: 1–948 or the corresponding full length or mature protein; and "substantial equivalents" thereof (e.g., with at least about 65%, at least about 70%, at least about 75%, at least about 80%, at least about 85%, 86%, 87%, 88%, 89%, at least about 90%, 91%, 92%, 93%, 94%, typically at least about 95%, 96%, 97%, more typically at least about 98%, or most typically at least about 99% amino acid identity) that retain biological activity. Polypeptides encoded by allelic variants may have a similar, increased, or decreased activity compared to polypeptides comprising SEQ ID NO: 1–948.

Fragments of the proteins of the present invention which are capable of exhibiting biological activity are also encompassed by the present invention. Fragments of the protein may be in linear form or they may be cyclized using known methods, for example, as described in H. U. Saragovi, et al., Bio/Technology 10, 773–778 (1992) and in R. S. McDowell, et al., J. Amer. Chem. Soc. 114, 9245–9253 (1992), both of which are incorporated herein by reference. Such fragments may be fused to carrier molecules such as immunoglobulins for many purposes, including increasing the valency of protein binding sites.

The present invention also provides both full-length and mature forms (for example, without a signal sequence or precursor sequence) of the disclosed proteins. The protein coding sequence is identified in the sequence listing by translation of the disclosed nucleotide sequences. The mature form of such protein may be obtained by expression of a full-length polynuclcotide in a suitable mammalian cell or other host cell. The sequence of the mature form of the protein is also determinable from the amino acid sequence of the full-length form. Where proteins of the present invention are membrane bound, soluble forms of the proteins are also provided. In such forms, part or all of the regions causing the proteins to be membrane bound are deleted so that the proteins are fully secreted from the cell in which they are expressed.

Protein compositions of the present invention may further comprise an acceptable carrier, such as a hydrophilic, e.g., pharmaceutically acceptable, carrier.

The present invention further provides isolated polypeptides encoded by the nucleic acid fragments of the present invention or by degenerate variants of the nucleic acid fragments of the present invention. By "degenerate variant" is intended nucleotide fragments which differ from a nucleic acid fragment of the present invention (e.g., an ORF) by nucleotide sequence but, due to the degeneracy of the genetic code, encode an identical polypeptide sequence. Preferred nucleic acid fragments of the present invention are the ORFs that encode proteins.

A variety of methodologies kcnown in the art can be utilized to obtain any one of the isolated polypeptides or proteins of the present invention. At the simplest level, the amino acid sequence can be synthesized using commercially available peptide synthesizers. The synthetically-constructed protein sequences, by virtue of sharing primary, secondary or tertiary structural and/or conformational characteristics with proteins may possess biological properties in common therewith, including protein activity. This technique is particularly useful in producing small peptides and fragments of larger polypeptides. Fragments are useful, for example, in generating antibodies against the native polypeptide. Thus, they may be employed as biologically active or immunological substitutes for natural, purified proteins in screening of therapeutic compounds and in immunological processes for the development of antibodies.

The polypeptides and proteins of the present invention can alternatively be purified from cells which have been altered to express the desired polypeptide or protein. As used herein, a cell is said to be altered to express a desired polypeptide or protein when the cell, through genetic manipulation, is made to produce a polypeptide or protein which it normally does not produce or which the cell normally produces at a lower level. One skilled in the art can readily adapt procedures for introducing and expressing either recombinant or synthetic sequences into eukaryotic or prokaryotic cells in order to generate a cell which produces one of the polypeptides or proteins of the present invention.

The invention also relates to methods for producing a polypeptide comprising growing a culture of host cells of the invention in a suitable culture medium, and purifying the protein from the cells or the culture in which the cells are grown. For example, the methods of the invention include a process for producing a polypeptide in which a host cell containing a suitable expression vector that includes a polynucleotide of the invention is cultured under conditions that allow expression of the encoded polypeptide. The polypeptide can be recovered from the culture, conveniently from the culture medium, or from a lysate prepared from the host cells and further purified. Preferred embodiments include those in which the protein produced by such process is a full length or mature form of the protein.

In an alternative method, the polypeptide or protein is purified from bacterial cells which naturally produce the polypeptide or protein. One skilled in the art can readily follow known methods for isolating polypeptides and proteins in order to obtain one of the isolated polypeptides or proteins of the present invention. These include, but are not limited to, immunochromatography, HPLC, size-exclusion chromatography, ion-exchange chromatography, and immuno-affinity chromatography. See, e.g., Scopes, *Protein Purification: Principles and Practice*, Springer-Verlag (1994); Sambrook, et al., in Molecular Cloning: *A Laboratory Manual*; Ausubel et al., *Current Protocols in Molecular Biology*. Polypeptide fragments that retain biological/immnunological activity include fragments comprising greater than about 100 amino acids, or greater than about 200 amino acids, and fragments that encode specific protein domains.

The purified polypeptides can be used in in vitro binding assays which are well known in the art to identify molecules which bind to the polypeptides. These molecules include but are not limited to, for e.g., small molecules, molecules from combinatorial libraries, antibodies or other proteins. The molecules identified in the binding assay are then tested for antagonist or agonist activity in in vivo tissue culture or animal models that are well known in the art. In brief, the molecules are titrated into a plurality of cell cultures or animals and then tested for either cell/animal death or prolonged survival of the animal/cells.

In addition, the peptides of the invention or molecules capable of binding to the peptides may be complexed with toxins, e.g., ricin or cholera, or with other compounds that are toxic to cells. The toxin-binding molecule complex is then targeted to a tumor or other cell by the specificity of the binding molecule for SEQ ID NO: 1–948.

The protein of the invention may also be expressed as a product of transgenic animals, e.g., as a component of the milk of transgenic cows, goats, pigs, or sheep which are characterized by somatic or germ cells containing a nucleotide sequence encoding the protein.

The proteins provided herein also include proteins characterized by amino acid sequences similar to those of purified proteins but into which modification are naturally provided or deliberately engineered. For example, modifications, in the peptide or DNA sequence, can be made by those skilled in the art using known techniques. Modifications of interest in the protein sequences may include the alteration, substitution, replacement, insertion or deletion of a selected amino acid residue in the coding sequence. For example, one or more of the cysteine residues may be deleted or replaced with another amino acid to alter the conformation of the molecule. Techniques for such alteration, substitution, replacement, insertion or deletion are well known to those skilled in the art (see, e.g., U.S. Pat. No. 4,518,584). Preferably, such alteration, substitution, replacement, insertion or deletion retains the desired activity of the protein. Regions of the protein that are important for the protein function can be determined by various methods known in the art including the alanine-scanning method which involved systematic substitution of single or strings of amino acids with alanine, followed by testing the resulting alanine-containing variant for biological activity. This type of analysis determines the importance of the substituted amino acid(s) in biological activity. Regions of the protein that are important for protein function may be determined by the eMATRIX program.

Other fragments and derivatives of the sequences of proteins which would be expected to retain protein activity in whole or in part and are useful for screening or other immunological methodologies may also be easily made by those skilled in the art given the disclosures herein. Such modifications are encompassed by the present invention.

The protein may also be produced by operably linking the isolated polynucleotide of the invention to suitable control sequences in one or more insect expression vectors, and employing an insect expression system. Materials and methods for baculovirus/insect cell expression systems are commercially available in kit form from, e.g., Invitrogen, San Diego, Calif., U.S.A. (the MaxBa™ kit), and such methods are well known in the art, as described in Summers and Smith, Texas Agricultural Experiment Station Bulletin No. 1555 (1987), incorporated herein by reference. As used herein, an insect cell capable of expressing a polynucleotide of the present invention is "transformed."

The protein of the invention may be prepared by culturing transformed host cells under culture conditions suitable to express the recombinant protein. The resulting expressed protein may then be purified from such culture (i.e., from culture medium or cell extracts) using known purification processes, such as gel filtration and ion exchange chromatography. The purification of the protein may also include an affinity column containing agents which will bind to the protein; one or more column steps over such affinity resins as concanavalin A-agarose, heparin-toyopearl™ or Cibacrom blue 3GA Sepharose™; one or more steps involving hydrophobic interaction chromatography using such resins as phenyl ether, butyl ether, or propyl ether; or immunoaffinity chromatography.

Alternatively, the protein of the invention may also be expressed in a form which will facilitate purification. For example, it may be expressed as a fulsion protein, such as those of maltose binding protein (MBP), glutathione-S-transferase (GST) or thioredoxin (TRX), or as a His tag. Kits for expression and purification of such fusion proteins are commercially available from New England BioLab (Beverly, Mass.), Pharmacia (Piscataway, N.J.) and Invitrogen, respectively. The protein can also be tagged with an epitope and subsequently purified by using a specific antibody directed to such epitope. One such epitope ("FLAG®") is commercially available from Kodak (New Haven, Conn.).

Finally, one or more reverse-phase high performance liquid chromatography (RP-BPLC) steps employing hydrophobic RP-HPLC media, e.g. silica gel having pendant methyl or other aliphatic groups, can be employed to further purify the protein. Some or all of the foregoing purification steps, in various combinations, can also be employed to provide a substantially homogeneous isolated recombinant protein. The protein thus purified is substantially free of other mammalian proteins and is defined in accordance with the present invention as an "isolated protein."

The polypeptides of the invention include analogs (variants). This embraces fragments, as well as peptides in which one or more amino acids has been deleted, inserted, or substituted. Also, analogs of the polypeptides of the invention embrace fusions of the polypeptides or modifications of the polypeptides of the invention, wherein the polypeptide or analog is fused to another moiety or moieties, e.g., targeting moiety or another therapeutic agent. Such analogs may exhibit improved properties such as activity and/or stability. Examples of moieties which may be fused to the polypeptide or an analog include, for example, targeting moieties which provide for the delivery of polypeptide to pancreatic cells, e.g., antibodies to pancreatic cells, antibodies to immune cells such as T-cells, monocytes, dendritic cells, granulocytes, etc., as well as receptor and ligands expressed on pancreatic or immune cells. Other moieties which may be fused to the polypeptide include therapeutic agents which are used for treatment, for example, immunosuppressive drugs such as cyclosporin, SK506, azathioprine, CD3 antibodies and steroids. Also, polypeptides may be fused to immune modulators, and other cytokines such as alpha or beta interferon.

3.6.1 Determining Polypeptide and Polynucleotide Identity and Similarity

Preferred identity and/or similarity are designed to give the largest match between the sequences tested. Methods to determine identity and similarity are codified in computer programs including, but are not limited to, the GCG program package, including GAP (Devereux, J., et al., Nucleic Acids Research 12(1):387 (1984); Genetics Computer Group, University of Wisconsin, Madison, Wis.), BLASTP, BLASTN, BLASTX, FASTA (Altschul, S. F. et al., J. Molec. Biol. 215:403–410 (1990), PSI-BLAST (Altschul S. F. et al., Nucleic Acids Res. vol. 25, pp. 3389–3402, herein incorporated by reference), eMatrix software (Wu et al., J. Comp. Biol., Vol. 6, pp. 219–235 (1999), herein incorporated by reference), eMotif software (Nevill-Manning et al, ISMB-97, Vol. 4, pp. 202–209, herein incorporated by reference), pFam software (Sornhammer et al., Nucleic Acids Res., Vol. 26(1), pp. 320–322 (1998), herein incorporated by reference) and the Kyte-Doolittle hydrophobocity prediction algorithm (J. Mol Biol, 157, pp. 105–31 (1982), incorporated herein by reference). The BLAST programs are publicly available from the National Center for Biotechnology Information (NCBI) and other sources (BLAST Manual, Altschul, S., et al. NCB NLM NIH Bethesda, Md. 20894; Altschul, S., et al., J. Mol. Biol. 215:403–410 (1990).

3.7 Chimeric and Fusion Proteins

The invention also provides chimeric or fusion proteins. As used herein, a "chimeric protein" or "fusion protein" comprises a polypeptide of the invention operatively linked to another polypeptide. Within a fusion protein the polypeptide according to the invention can correspond to all or a portion of a protein according to the invention. In one embodiment, a fusion protein comprises at least one biologically active portion of a protein according to the invention. In another embodiment, a fusion protein comprises at least two biologically active portions of a protein according to the invention. Within the fusion protein, the term "operatively linked" is intended to indicate that the polypeptide according to the invention and the other polypeptide are fused in-frame to each other. The polypeptide can be fused to the N-terminus or C-terminus, or to the middle.

For example, in one embodiment a fusion protein comprises a polypeptide according to the invention operably linked to the extracellular domain of a second protein.

In another embodiment, the fusion protein is a GST-fusion protein in which the polypeptide sequences of the invention are fused to the C-terminus of the GST (i.e., glutathione S-transferase) sequences.

In another embodiment, the fusion protein is an immunoglobulin fusion protein in which the polypeptide sequences according to the invention comprise one or more domains fused to sequences derived from a member of the immunoglobulin protein family. The immnunoglobulin fusion proteins of the invention can be incorporated into pharmaceutical compositions and administered to a subject to inhibit an interaction between a ligand and a protein of the invention on the surface of a cell, to thereby suppress signal transduction in vivo. The immunoglobulin fusion proteins can be used to affect the bioavailability of a cognate ligand. Inhibition of the ligand/protein interaction may be useful therapeutically for both the treatment of proliferative and differentiative disorders, e.g., cancer as well as modulating (e.g., promoting or inhibiting) cell survival. Moreover, the immunoglobulin fusion proteins of the invention can be used as immunogens to produce antibodies in a subject, to purify ligands, and in screening assays to identify molecules that inhibit the interaction of a polypeptide of the invention with a ligand.

A chimeric or fiusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, for example, Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the protein of the invention.

3.8 Gene Therapy

Mutations in the polynucleotides of the invention gene may result in loss of normal function of the encoded protein. The invention thus provides gene therapy to restore normal activity of the polypeptides of the invention; or to treat disease states involving polypeptides of the invention. Delivery of a functional gene encoding polypeptides of the invention to appropriate cells is effected ex vivo, in situ, or in vivo by use of vectors, and more particularly viral vectors (e.g., adenovirus, adeno-associated virus, or a retrovirus), or ex vivo by use of physical DNA transfer methods (e.g., liposomes or chemical treatments). See, for example, Anderson, Nature, supplement to vol. 392, no. 6679, pp.25–20 (1998). For additional reviews of gene therapy technology see Friedmann, Science, 244: 1275–1281 (1989); Verma, Scientific American: 68–84 (1990); and Miller, Nature, 357: 455460(1992). Introduction of any one of the nucleotides of the present invention or a gene encoding the polypeptides of the present invention can also be accomplished with extrachromosomal substrates (transient expression) or artificial chromosomes (stable expression). Cells may also be cultured ex vivo in the presence of proteins of the present invention in order to proliferate or to produce a desired effect on or activity in such cells. Treated cells can then be introduced in vivo for therapeutic purposes. Alternatively, it is contemplated that in other human disease states, preventing the expression of or inhibiting the activity of polypeptides of the invention will be useful in treating the disease states. It is contemplated that antisense therapy or gene therapy could be applied to negatively regulate the expression of polypeptides of the invention.

Other methods inhibiting expression of a protein include the introduction of antisense molecules to the nucleic acids of the present invention, their complements, or their translated RNA sequences, by methods known in the art. Further, the polypeptides of the present invention can be inhibited by using targeted deletion methods, or the insertion of a negative regulatory element such as a silencer, which is tissue specific.

The present invention still further provides cells genetically engineered in vivo to express the polynucleotides of the invention, wherein such polynucleotides are in operative association with a regulatory sequence heterologous to the host cell which drives expression of the polynucleotides in the cell. These methods can be used to increase or decrease the expression of the polynucleotides of the present invention.

Knowledge of DNA sequences provided by the invention allows for modification of cells to permit, increase, or decrease, expression of endogenous polypeptide. Cells can be modified (e.g., by homologous recombination) to provide increased polypeptide expression by replacing, in whole or in part, the naturally occurring promoter with all or part of a heterologous promoter so that the cells express the protein at higher levels. The heterologous promoter is inserted in such a manner that it is operatively linked to the desired protein encoding sequences. See, for example, PCT International Publication No. WO 94/12650, PCT International Publication No. WO 92/20808, and PCT International Publication No. WO 91/09955. It is also contemplated that, in addition to heterologous promoter DNA, amplifiable marker DNA (e.g., ada, dhfr, and the multifunctional CAD gene which encodes carbamyl phosphate synthase, aspartate transcarbamylase, and dihydroorotase) and/or intron DNA may be inserted along with the heterologous promoter DNA. If linked to the desired protein coding sequence, amplification of the marker DNA by standard selection methods results in co-amplification of the desired protein coding sequences in the cells.

In another embodiment of the present invention, cells and tissues may be engineered to express an endogenous gene comprising the polynucleotides of the invention under the control of inducible regulatory elements, in which case the regulatory sequences of the endogenous gene may be replaced by homologous recombination. As described herein, gene targeting can be used to replace a gene's existing regulatory region with a regulatory sequence isolated from a different gene or a novel regulatory sequence synthesized by genetic engineering methods. Such regulatory sequences may be comprised of promoters, enhancers, scaffold-attachment regions, negative regulatory elements, transcriptional initiation sites, regulatory protein binding sites or combinations of said sequences. Alternatively, sequences which affect the structure or stability of the RNA or protein produced may be replaced, removed, added, or otherwise modified by targeting. These sequences include polyadenylation signals, mRNA stability elements, splice sites, leader sequences for enhancing or modifying transport or secretion properties of the protein, or other sequences which alter or improve the function or stability of protein or RNA molecules.

The targeting event may be a simple insertion of the regulatory sequence, placing the gene under the control of the new regulatory sequence, e.g., inserting a new promoter or enhancer or both upstream of a gene. Alternatively, the targeting event may be a simple deletion of a regulatory element, such as the deletion of a tissue-specific negative regulatory element. Alternatively, the targeting event may replace an existing element; for example, a tissue-specific enhancer can be replaced by an enhancer that has broader or different cell-type specificity than the naturally occurring elements. Here, the naturally occurring sequences are deleted and new sequences are added. In all cases, the identification of the targeting event may be facilitated by the use of one or more selectable marker genes that are contiguous with the targeting DNA, allowing for the selection of cells in which the exogenous DNA has integrated into the cell genome. The identification of the targeting event may also be facilitated by the use of one or more marker genes exhibiting the property of negative selection, such that the negatively selectable marker is linked to the exogenous DNA, but configured such that the negatively selectable marker flanks the targeting sequence, and such that a correct homologous recombination event with sequences in the host cell genome does not result in the stable integration of the negatively selectable marker. Markers useful for this purpose include the Herpes Simplex Virus thymidine kinase (TK) gene or the bacterial xanthine-guanine phosphoribosyl-transferase (gpt) gene.

The gene targeting or gene activation techniques which can be used in accordance with this aspect of the invention are more particularly described in U.S. Pat. No. 5,272,071 to Chappel; U.S. Pat. No. 5,578,461 to Sherwin et al.; International Application No. PCT/US92/09627 (WO93/09222) by Selden et al.; and International Application No. PCT/US90/06436 (WO91/06667) by Skoultchi et al., each of which is incorporated by reference herein in its entirety.

3.9 Transgenic Animals

In preferred methods to determine biological functions of the polypeptides of the invention in vivo, one or more genes provided by the invention are either over expressed or inactivated in the germ line of animals using homologous recombination [Capecchi, Science 244:1288–1292 (1989)]. Animals in which the gene is over expressed, under the regulatory control of exogenous or endogenous promoter elements, are known as transgenic animals. Animals in which an endogenous gene has been inactivated by homologous recombination are referred to as "knockout" animals. Knockout animals, preferably non-human mammals, can be prepared as described in U.S. Pat. No. 5,557,032, incorporated herein by reference. Transgenic animals are useful to determine the roles polypeptides of the invention play in biological processes, and preferably in disease states. Transgenic animals are useful as model systems to identify compounds that modulate lipid metabolism. Transgenic animals, preferably non-human mammals, are produced using methods as described in U.S. Pat. No. 5,489,743 and PCT Publication No. WO94/28122, incorporated herein by reference.

Transgenic animals can be prepared wherein all or part of a promoter of the polynucleotides of the invention is either activated or inactivated to alter the level of expression of the polypeptides of the invention. Inactivation can be carried out using homologous recombination methods described above. Activation can be achieved by supplementing or even replacing the homologous promoter to provide for increased protein expression. The homologous promoter can be supplemented by insertion of one or more heterologous enhancer elements known to confer promoter activation in a particular tissue.

The polynucleotides of the present invention also make possible the development, through, e.g., homologous recombination or knock out strategies, of animals that fail to express polypeptides of the invention or that express a variant polypeptide. Such animals are useful as models for studying the in vivo activities of polypeptide as well as for studying modulators of the polypeptides of the invention.

In preferred methods to determine biological functions of the polypeptides of the invention in vivo, one or more genes provided by the invention are either over expressed or inactivated in the germ line of animals using homologous recombination [Capecchi, Science 244:1288–1292 (1989)]. Animals in which the gene is over expressed, under the regulatory control of exogenous or endogenous promoter elements, are known as transgenic animals. Animals in which an endogenous gene has been inactivated by homologous recombination are referred to as "knockout" animals. Knockout animals, preferably non-human mammals, can be prepared as described in U.S. Pat. No. 5,557,032, incorporated herein by reference. Transgenic animals are useful to determine the roles polypeptides of the invention play in biological processes, and preferably in disease states. Transgenic animals are useful as model systems to identify compounds that modulate lipid metabolism. Transgenic animals, preferably non-human mammals, are produced using methods as described in U.S. Pat. No. 5,489,743 and PCT Publication No. WO94/28122, incorporated herein by reference.

Transgenic animals can be prepared wherein all or part of the polynucleotides of the invention promoter is either activated or inactivated to alter the level of expression of the polypeptides of the invention. Inactivation can be carried out using homologous recombination methods described above. Activation can be achieved by supplementing or even replacing the homologous promoter to provide for increased protein expression. The homologous promoter can be supplemented by insertion of one or more heterologous enhancer elements known to confer promoter activation in a particular tissue.

3.10 Uses and Biological Activity

The polynucleotides and proteins of the present invention are expected to exhibit one or more of the uses or biological activities (including those associated with assays cited herein) identified herein. Uses or activities described for proteins of the present invention may be provided by administration or use of such proteins or of polynucleotides encoding such proteins (such as, for example, in gene therapies or vectors suitable for introduction of DNA). The mechanism underlying the particular condition or pathology will dictate whether the polypeptides of the invention, the polynucleotides of the invention or modulators (activators or inhibitors) thereof would be beneficial to the subject in need of treatment. Thus, "therapeutic compositions of the invention" include compositions comprising isolated polynucleotides (including recombinant DNA molecules, cloned genes and degenerate variants thereof) or polypeptides of the invention (including full length protein, mature protein and truncations or domains thereof), or compounds and other substances that modulate the overall activity of the target gene products, either at the level of target gene/protein expression or target protein activity. Such modulators include polypeptides, analogs, (variants), including fragments and fusion proteins, antibodies and other binding proteins; chemical compounds that directly or indirectly activate or inhibit the polypeptides of the invention (identified, e.g., via drug screening assays as described herein); antisense polynucleotides and polynucleotides suitable for triple helix formation; and in particular antibodies or other binding partners that specifically recogrize one or more epitopes of the polypeptides of the invention.

The polypeptides of the present invention may likewise be involved in cellular activation or in one of the other physiological pathways described herein.

3.10.1 Research Uses and Utilities

The polynucleotides provided by the present invention can be used by the research community for various purposes. The polynucleotides can be used to express recombinant protein for analysis, characterization or therapeutic use; as markers for tissues in which the corresponding protein is preferentially expressed (either constitutively or at a particular stage of tissue differentiation or development or in disease states); as molecular weight markers on gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; as a probe to "subtract-out" known sequences in the process of discovering other novel polynucleotides; for selecting and making oligomers for attachment to a "gene chip" or other support, including for examination of expression patterns; to raise anti-protein antibodies using DNA immunization techniques; and as an antigen to raise anti-DNA antibodies or elicit another immune response. Where the polynucleotide encodes a protein which binds or potentially binds to another protein (such as, for example, in a receptor-ligand interaction), the polynucleotide can also be used in interaction trap assays (such as, for example, that described in Gyuris et al., Cell 75:791–803 (1993)) to identify polynucleotides encoding the other protein with which binding occurs or to identify inhibitors of the binding interaction.

The polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding polypeptide is preferentially expressed (either constitutively or at a particular stage of tissue differentiation or development or in a disease state); and, of course, to isolate correlative receptors or ligands. Proteins involved in these binding interactions can also be used to screen for peptide or small molecule inhibitors or agonists of the binding interaction.

Any or all of these research utilities are capable of being developed into reagent grade or kit format for corrjercialization as research products.

Methods for performing the uses listed above are well known to those skilled in the art. References disclosing such methods include without limitation "Molecular Cloning: A Laboratory Manual", 2d ed., Cold Spring Harbor Laboratory Press, in Sambrook, J., E. F. Fritsch and T. Maniatis eds., 1989, and "Methods in Enzymology: Guide to Molecular Cloning Techniques", Academic Press, Berger, S. L. and A. R Kimmel eds., 1987.

3.10.2 Nutritional Uses

Polynucleotides and polypeptides of the present invention can also be used as nutritional sources or supplements. Such uses include without limitation use as a protein or amino acid supplement, use as a carbon source, use as a nitrogen source and use as a source of carbohydrate. In such cases the polypeptidc or polynucleotide of the invention can be added to the feed of a particular organism or can be administered as a separate solid or liquid preparation, such as in the form of powder, pills, solutions, suspensions or capsules. In the case of microorganisms, the polypeptide or polynucleotide of the invention can be added to the medium in or on which the microorganism is cultured.

3.10.3 Cytokine and Cell Proliferation/Differentiation Activity

A polypeptide of the present invention may exhibit activity relating to cytokine, cell proliferation (either inducing or inhibiting) or cell differentiation (either inducing or inhibiting) activity or may induce production of other cytokines in certain cell populations. A polynucleotide of the invention can encode a polypeptide exhibiting such attributes. Many protein factors discovered to date, including all known cytokines, have exhibited activity in one or more factor-dependent cell proliferation assays, and hence the assays serve as a convenient confirmation of cytokine activity. The activity of therapeutic compositions of the present invention is evidenced by any one of a number of routine factor dependent cell proliferation assays for cell lines including, without limitation, 32D, DA2, DA1G, T10, B9, B9/11, BaF3, MC9/G, M+(preB M+), 2E8, RB5, DA1, 123, T1165, HT2, CTLL2, TF-1, Mo7e, CMK, HUVEC, and Caco. Therapeutic compositions of the invention can be used in the following:

Assays for T-cell or thymocyte proliferation include without limitation those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Takai et al., J. Immunol. 137:3494–3500, 1986; Bertagnolli et al., J. Immunol. 145:1706–1712, 1990; Bertagnolli et al., Cellular Imrnunology 133:327–341, 1991; Bertagnolli, et al., I. Immunol. 149:3778–3783, 1992; Bowman et al., I. Immunol. 152:1756–1761, 1994.

Assays for cytokine production and/or proliferation of spleen cells, lymph node cells or thymocytes include, without limitation, those described in: Polyclonal T cell stimulation, Kruisbeek, A. M. and Shevach, E. M. In Current Protocols in Immunology. J. E. e.a. Coligan eds. Vol 1 pp. 3.12.1–3.12.14, John Wiley and Sons, Toronto. 1994; and Measurement of mouse and human interleukin-y, Schreiber, R. D. In Current Protocols in Immunology. J. E. e.a. Coligan eds. Vol 1 pp. 6.8.1–6.8.8, John Wiley and Sons, Toronto. 1994.

Assays for proliferation and differentiation of hematopoietic and lymphopoietic cells include, without limitation, those described in: Measurement of Human and Murine Interleukin 2 and Interleukin 4, Bottomly, K., Davis, L. S. and Lipsky, P. E. In Current Protocols in Immunology. J. E. e.a. Coligan eds. Vol 1 pp. 6.3.1–6.3.12, John Wiley and Sons, Toronto. 1991; devries et al., J. Exp. Med. 173:1205–1211, 1991; Moreau et al., Nature 336:690–692, 1988; Greenberger et al., Proc. Natl. Acad. Sci. U.S.A. 80:2931–2938, 1983; Measurement of mouse and human interleukin 6—Nordan, R. In Current Protocols in Immunology. J. E. Coligan eds. Vol 1 pp. 6.6.1–6.6.5, John Wilcy and Sons, Toronto. 1991; Smith et al., Proc. Natl. Aced. Sci. U.S.A. 83:1857–1861, 1986; Measurement of human Interleukin 11—Bennett, F., Giannotti, J., Clark, S. C. and Turner, K. J. In Current Protocols in Immunology. J. E.

Coligan eds. Vol 1 pp. 6.15.1 John Wiley and Sons, Toronto. 1991; Measurement of mouse and human Interlcukin 9—Ciarletta, A., Giannotti, J., Clark, S. C. and Turner, K. J. In Current Protocols in Imnnunology. J. E. Coligan eds. Vol I pp. 6.13.1, John Wiley and Sons, Toronto. 1991.

Assays for T-cell clone responses to antigens (which will identify, among others, proteins that affect APC-T cell interactions as well as direct T-cell effects by measuring proliferation and cytokine production) include, without limitation, those described in: A Current Protocols in Immunology, Ed by J. E. Coligan, A. M. Kruisbeek, D. H. Margulies, E. M. Shevach, W Strober, Pub. Greene Publishing Associates and Wiley-Interscience (Chapter 3, In Vitro assays for Mouse Lymphocyte Function; Chapter 6, Cytokines and their cellular receptors; Chapter 7, Immunologic studies in Humans); Weinberger et al., Proc. Natl. Acad. Sci. USA 77:6091–6095, 1980; Weinberger et al., Eur. J. Immun. 11:405–411, 1981; Takai et al., J. Immunol. 137:3494–3500, 1986; Takai et al., J. Immunol. 140:508–512, 1988.

3.10.4 Stem Cell Growth Factor Activity

A polypeptide of the present invention may exhibit stem cell growth factor activity and be involved in the proliferation, differentiation and survival of pluripotent and totipotent stem cells including primordial germ cells, embryonic stem cells, hematopoietic stem cells and/or germ line stem cells. Administration of the polypeptide of the invention to stem cells in vivo or ex vivo is expected to maintain and expand cell populations in a totipotential or pluripotential state which would be useful for re-engineering damaged or diseased tissues, transplantation, manufacture of biopharmaceuticals and the development of bio-sensors. The ability to produce large quantities of human cells has important working applications for the production of human proteins which currently must be obtained from non-human sources or donors, implantation of cells to treat diseases such as Parkinson's, Alzheimer's and other neurodegenerative diseases; tissues for grafting such as bone marrow, skin, cartilage, tendons, bone, muscle (including cardiac muscle), blood vessels, cornea, neural cells, gastrointestinal cells and others; and organs for transplantation such as kidney, liver, pancreas (including islet cells), heart and lung.

It is contemplated that multiple different exogenous growth factors and/or cytokines may be administered in combination with the polypeptide of the invention to achieve the desired effect, including any of the growth factors listed herein, other stem cell maintenance factors, and specifically including stem cell factor (SCF), leukemia inhibitory factor (LIF), Flt-3 ligand (Flt-3L), any of the interleukins, recombinant soluble IL-6 receptor fused to IL-6, macrophage inflammatory protein 1-alpha (MIP-1-alpha), G-CSF, GM-CSF, thrombopoietin (TPO), platelet factor 4 (PF-4), platelet-derived growth factor (PDGF), neural growth factors and basic fibroblast growth factor (bFGF).

Since totipotent stem cells can give rise to virtually any mature cell type, expansion of these cells in culture will facilitate the production of large quantities of mature cells. Techniques for culturing stem cells are known in the art and administration of polypeptides of the invention, optionally with other growth factors and/or cytokines, is expected to enhance the survival and proliferation of the stem cell populations. This can be accomplished by direct administration of the polypeptide of the invention to the culture medium. Alternatively, stroma cells transfected with a polynucleotide that encodes for the polypeptide of the invention can be used as a feeder layer for the stem cell populations in culture or in vivo. Stromal support cells for feeder layers may include embryonic bone marrow fibroblasts, bone marrow stromal cells, fetal liver cells, or cultured embryonic fibroblasts (see U.S. Pat. No. 5,690,926).

Stem cells themselves can be transfected with a polynucleotide of the invention to induce autocrine expression of the polypeptide of the invention. This will allow for generation of undifferentiated totipotential/pluripotential stem cell lines that are useful as is or that can then be differentiated into the desired mature cell types. These stable cell lines can also serve as a source of undifferentiated totipotential/pluripotential mRNA to create cDNA libraries and templates for polymerase chain reaction experiments. These studies would allow for the isolation and identification of differentially expressed genes in stem cell populations that regulate stem cell proliferation and/or maintenance.

Expansion and maintenance of totipotent stem cell populations will be useful in the treatment of many pathological conditions. For example, polypeptides of the present invention may be used to manipulate stem cells in culture to give rise to neuroepithelial cells that can be used to augment or replace cells damaged by illness, autoimmune disease, accidental damage or genetic disorders. The polypeptide of the invention may be useful for inducing the proliferation of neural cells and for the regeneration of nerve and brain tissue, i.e. for the treatment of central and peripheral nervous system diseases and neuropathies, as well as mechanical and traumatic disorders which involve degeneration, death or trauma to neural cells or nerve tissue. In addition, the expanded stem cell populations can also be genetically altered for gene therapy purposes and to decrease host rejection of replacement tissues after grafting or implantation.

Expression of the polypeptide of the invention and its effect on stem cells can also be manipulated to achieve controlled differentiation of the stem cells into more differentiated cell types. A broadly applicable method of obtaining pure populations of a specific differentiated cell type from undifferentiated stem cell populations involves the use of a cell-type specific promoter driving a selectable marker. The selectable marker allows only cells of the desired type to survive. For example, stem cells can be induced to differentiate into cardiomyocytes (Wobus et al., Differentiation, 48: 173–182, (1991); Klug et al., J. Clin. Invest., 98(1): 216–224, (1998)) or skeletal muscle cells (Browder, L. W. In: *Principles of Tissue Engineering eds.* Lanza et al., Acadernic Press (1997)). Alternatively, directed differentiation of stem cells can be accomplished by culturing the stem cells in the presence of a differentiation factor such as retinoic acid and an antagonist of the polypeptide of the invention which would inhibit the effects of endogenous stem cell factor activity and allow differentiation to proceed.

In vitro cultures of stem cells can be used to determine if the polypeptide of the invention exhibits stem cell growth factor activity. Stem cells are isolated from any one of various cell sources (including hematopoietic stem cells and embryonic stem cells) and cultured on a feeder layer, as described by Thompson et al. Proc. Natl. Acad. Sci, U.S.A., 92: 7844–7848 (1995), in the presence of the polypeptide of the invention alone or in combination with other growth factors or cytokines. The ability of the polypeptide of the invention to induce stem cells proliferation is determined by colony formation on semi-solid support e.g. as described by Bernstein et al., Blood, 77: 2316–2321 (1991).

3.10.5 Hematopoiesis Regulating Activity

A polypeptide of the present invention may be involved in regulation of hematopoiesis and, consequently, in the treatment of myeloid or lymphoid cell disorders. Even marginal biological activity in support of colony forming cells or of factor-dependent cell lines indicates involvement in regulating hematopoiesis, e.g. in supporting the growth and proliferation of erythwid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelosuppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantation, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically manipulated for gene therapy.

Therapeutic compositions of the invention can be used in the following:

Suitable assays for proliferation and differentiation of various hematopoietic lines are cited above.

Assays for embryonic stem cell differentiation (which will identify, among others, proteins that influence embryonic differentiation hematopoiesis) include, without limitation, those described in: Johansson et al. Cellular Biology 15:141–151, 1995; Keller et al., Molecular and Cellular Biology 13:473–486, 1993; McClanahan et al., Blood 81:2903–2915, 1993.

Assays for stem cell survival and differentiation (which will identify, among others, proteins that regulate lymphohematopoiesis) include, without limitation, those described in: Methylcellulose colony formring assays, Freshney, M. G. In Culture of Hematopoietic Cells. R. L. Freshney, et al. eds. Vol pp. 265–268, Wiley-Liss, Inc., New York, N.Y. 1994; Hirayama et al., Proc. Natl. Acad. Sci. USA 89:5907–5911, 1992; Primitive hematopoietic colony forming cells with high proliferative potential, McNiece, I. K. and Briddell, R. A. In Culture of Hematopoietic Cells. R. I. Freshney, et al. eds. Vol pp. 23–39, Wiley-Liss, Inc., New York, N.Y. 1994; Neben et al., Experimental Hematology 22:353–359, 1994; Cobblestone area forming cell assay, Ploemacher, R. E. In Culture of Hematopoietic Cells. R. I. Freshney, et al. eds. Vol pp. 1–21, Wiley-Liss, Inc., New York, N.Y. 1994; Long term bone marrow cultures in the presence of stromal cells, Spooncer, E., Dexter, M. and Allen, T. In Culture of Hematopoietic Cells. R. I. Freshney, et al. eds. Vol pp. 163–179, Wiley-Liss, Inc., New York, N.Y. 1994; Long term culture initiating cell assay, Sutherland, H. J. In Culture of Hematopoietic Cells. R I. Freshney, et al. eds. Vol pp. 139–162, Wiley-Liss, Inc., New York, N.Y. 1994.

3.10.6 Tissue Growth Activity

A polypeptide of the present invention also may be involved in bone, cartilage, tendon, ligament and/or nerve tissue growth or regeneration, as well as in wound healing and tissue repair and replacement, and in healing of bums, incisions and ulcers.

A polypeptide of the present invention which induces cartilage and/or bone growth in circumstances where bone is not normally formed, has application in the healing of bone fractures and cartilage damage or defects in humans and other animals. Compositions of a polypeptide, antibody, binding partner, or other modulator of the invention may have prophylactic use in closed as well as open fracture reduction and also in the improved fixation of artificial joints. De novo bone formation induced by an osteogenic agent contributes to the repair of congenital, trauma induced, or oncologic resection induced craniofacial defects, and also is useful in cosmetic plastic surgery.

A polypeptide of this invention may also be involved in attracting bone-forming cells, stimulating growth of bone-formning cells, or inducing differentiation of progenitors of bone-forming cells. Treatment of osteoporosis, osteoarthritis, bone degenerative disorders, or periodontal disease, such as through stimulation of bone and/or cartilage repair or by blocking inflammation or processes of tissue destruction (collagenase activity, osteoclast activity, etc.) mediated by inflammatory processes may also be possible using the composition of the invention.

Another category of tissue regeneration activity that may involve the polypeptide of the present invention is tendon/ligament formation. Induction of tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a composition of the present invention contributes to the repair of congenital, trauma induced, or other tendon or ligament defects of other origin, and is also useful in cosmetic plastic surgery for attachment or repair of tendons or ligaments. The compositions of the present invention may provide environment to attract tendon- or ligament-forrning cells, stimulate growth of tendon- or ligament-forming cells, induce differentiation of progenitors of tendon- or ligament-forming cells, or induce growth of tendon/liganent cells or progenitors ex vivo for return in vivo to effect tissue repair. The compositions of the invention may also be useful in the treatment of tendinitis, carpal tunnel syndrome and other tendon or ligament defects. The compositions may also include an appropriate matrix and/or sequestering agent as a carrier as is well known in the art.

The compositions of the present invention may also be useful for proliferation of neural cells and for regeneration of nerve and brain tissue, i.e. for the treatment of central and peripheral nervous system diseases and neuropathies, as well as mechanical and traumatic disorders, which involve degeneration, death or trauma to neural cells or nerve tissue. More specifically, a composition may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a composition of the invention.

Compositions of the invention may also be useful to promote better or faster closure of non-healing wounds, including without limitation pressure ulcers, ulcers associated with vascular insufficiency, surgical and traumatic wounds, and the like.

Compositions of the present invention may also be involved in the generation or regeneration of other tissues, such as organs (including, for example, pancreas, liver, intestine, kidney, skin, endothelium), muscle (smooth, skeletal or cardiac) and vascular (including vascular endothelium) tissue, or for promoting the growth of cells comprising such tissues. Part of the desired effects may be by inhibition or modulation of fibrotic scarring may allow normal tissue to regenerate. A polypeptide of the present invention may also exhibit angiogenic activity.

A composition of the present invention may also be useful for gut protection or regeneration and treatment of lung or liver fibrosis, reperfusion injury in various tissues, and conditions resulting from systemic cytokine damage.

A composition of the present invention may also be useful for promoting or inhibiting differentiation of tissues described above from precursor tissues or cells; or for inhibiting the growth of tissues described above.

Therapeutic compositions of the invention can be used in the following:

Assays for tissue generation activity include, without limitation, those described in: International Patent Publication No. WO95/16035 (bone, cartilage, tendon); International Patent Publication No. WO95/05846 (nerve, neuronal); International Patent Publication No. WO91/07491 (skin, endothelium).

Assays for wound healing activity include, without limitation, those described in: Winter, Epidermal Wound Healing, pps. 71–112 (Maibach, H. L. and Rovee, D. T., eds.), Year Book Medical Publishers, Inc., Chicago, as modified by Eaglstein and Mertz, J. Invest. Dermatol 71:382–84 (1978).

3.10.7 Immune Stimulating or Suppressing Activity

A polypeptide of the present invention may also exhibit immune stimulating or immune suppressing activity, including without limitation the activities for which assays are described herein. A polynucleotide of the invention can encode a polypeptide exhibiting such activities. A protein may be useful in the treatment of various immune deficiencies and disorders (including severe combined immunodeficiency (SCID)), e.g., in regulating (up or down) growth and proliferation of T and/or B lymphocytes, as well as effecting the cytolytic activity of NK cells and other cell populations. These immune deficiencies may be genetic or be caused by viral (e.g., HI) as well as bacterial or fungal infections, or may result from autoimmune disorders. More specifically, infectious diseases causes by viral, bacterial, ftngal or other infection may be treatable using a protein of the present invention, including infections by HIV, hepatitis viruses, herpes viruses, mycobacteria, Leishmania spp., malaria spp. and various fungal infections such as candidiasis. Of course, in this regard, proteins of the present invention may also be useful where a boost to the immune system generally may be desirable, i.e., in the treatment of cancer.

Autoimmune disorders which may be treated using a protein of the present invention include, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitus, myasthenia gravis, graft-versus-host disease and autoimmune inflammatory eye disease. Such a protein (or antagonists thereof, including antibodies) of the present invention may also to be useful in the treatment of allergic reactions and conditions (e.g., anaphylaxis, serum sickness, drug reactions, food allergies, insect venom allergies, mastocytosis, allergic rhinitis, hypersensitivity pneumonitis, urticaria, angioedema, eczema, atopic dermatitis, allergic contact dermatitis, erythema multiforme, Stevens-Johnson syndrome, allergic conjunctivitis, atopic keratoconjunctivitis, venereal keratoconjunctivitis, giant papillary conjunctivitis and contact allergies), such as asthma (particularly allergic asthma) or other respiratory problems. Other conditions, in which inrnune suppression is desired (including, for example, organ transplantation), may also be treatable using a protein (or antagonists thereof) of the present invention. The therapeutic effects of the polypeptides or antagonists thereof on allergic reactions can be evaluated by in vivo animals models such as the cumulative contact enhancement test (Lastbom et al., Toxicology 125: 59–66, 1998), skin prick test (Hoffmann et al., Allergy 54: 446–54, 1999), guinea pig skin sensitization test (Vohr et al., Arch. Toxocol. 73: 501–9), and murine local lymph node assay (Kimber et al., J. Toxicol. Environ. Health 53: 563–79).

Using the proteins of the invention it may also be possible to modulate immune responses, in a number of ways. Down regulation may be in the form of inhibiting or blocking an immune response already in progress or may involve preventing the induction of an immune response. The functions of activated T cells may be inhibited by suppressing T cell responses or by inducing specific tolerance in T cells, or both. Immunosuppression of T cell responses is generally an active, non-antigen-specific, process which requires continuous exposure of the T cells to the suppressive agent. Tolerance, which involves inducing non-responsiveness or anergy in T cells, is distinguishable from immunosuppression in that it is generally antigen-specific and persists after exposure to the tolerizing agent has ceased. Operationally, tolerance can be demonstrated by the lack of a T cell response upon reexposure to specific antigen in the absence of the tolerizing agent.

Down regulating or preventing one or more antigen functions (including without limitation B lymphocyte antigen functions (such as, for example, B7)), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a therapeutic composition of the invention may prevent cytokine synthesis by immune cells, such as T cells, and thus acts as an immunosuppressant. Moreover, a lack of costimulation may also be sufficient to energize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular therapeutic compositions in preventing organ transplant rejection or GVHD can be assessed using animal models that are predictive of efficacy in humans. Examples of appropriate systems which can be used include allogeneic cardiac grafts in rats and xenogeneic pancreatic islet cell grafts in mice, both of which have been used to examine the immunosuppressive effects of CTLA4Ig fusion proteins in vivo as described in Lenschow et al., Science 257:789–792 (1992) and Turka et al., Proc. Natl. Acad. Sci USA, 89:11102–11105 (1992). In addition, murine models of GVHD (see Paul ed., Fundamental Immunology, Raven Press, New York, 1989, pp. 846–847) can be used to determine the effect of therapeutic compositions of the invention on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block stimulation of T cells can be used to inhibit T cell activation and prevent production of autoantibodies or T cell-derived cytokines which may be involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/lpr/lpr mice or NZB hybrid mice, murine autoimmune collagen arthritis, diabetes mellitus in NOD mice and BB rats, and murine experimental myasthenia gravis (see Paul ed., Fundamental Immunology, Raven Press, New York, 1989, pp. 840–856).

Upregulation of an antigen function (e.g., a B lymphocyte antigen function), as a means of up regulating immune responses, may also be useful in therapy. Upregulation of immune responses may be in the form of enhancing an existing immune response or eliciting an initial immune response. For example, enhancing an immune response may be useful in cases of viral infection, including systemic viral diseases such as influenza, the common cold, and encephalitis.

Alternatively, anti-viral immune responses may be enhanced in an infected patient by removing T cells from the patient, costimulating the T cells in vitro with viral antigen-pulsed APCs either expressing a peptide of the present invention or together with a stimulatory form of a soluble peptide of the present invention and reintroducing the in vitro activated T cells into the patient. Another method of enhancing anti-viral immune responses would be to isolate infected cells from a patient, transfect them with a nucleic acid encoding a protein of the present invention as described herein such that the cells express all or a portion of the protein on their surface, and reintroduce the transfected cells into the patient. The infected cells would now be capable of delivering a costimulatory signal to, and thereby activate, T cells in vivo.

A polypeptide of the present invention may provide the necessary stimulation signal to T cells to induce a T cell mediated immune response against the transfected tumor cells. In addition, tumor cells which lack MHC class I or MHC class II molecules, or which fail to reexpress sufficient mounts of MHC class I or MHC class II molecules, can be transfected with nucleic acid encoding all or a portion of (e.g., a cytoplasmic-domain truncated portion) of an MHC class I alpha chain protein and $\beta_2$ microglobulin protein or an MHC class II alpha chain protein and an MHC class II beta chain protein to thereby express MHC class I or MHC class II proteins on the cell surface. Expression of the appropriate class I or class II MHC in conjunction with a peptide having the activity of a B lymphocyte antigen (e.g., B7-1, B7-2, B7-3) induces a T cell mediated immune response against the transfected tumor cell. Optionally, a gene encoding an antisense construct which blocks expression of an MHC class II associated protein, such as the invariant chain, can also be cotransfected with a DNA encoding a peptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject.

The activity of a protein of the invention may, among other means, be measured by the following methods:

Suitable assays for thymocyte or splenocyte cytotoxicity include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Herrmann et al., Proc. Natl. Acad. Sci. USA 78:2488–2492, 1981; Herrmann et al., J. Immunol. 128:1968–1974, 1982; Handa et al., J. Immunol. 135:1564–1572, 1985; Takai et al., I. Immunol. 137:3494–3500, 1986; Takai et al., J. Immunol. 140:508–512, 1988; Bowman et al., J. Virology 61:1992–1998; Bertagnolli et al., Cellular Immunology 133:327–341, 1991; Brown et al., J. Immunol. 153:3079–3092, 1994.

Assays for T-cell-dependent immunoglobulin responses and isotype switching (which will identify, among others, proteins that modulate T-cell dependent antibody responses and that affect Th1/Th2 profiles) include, without limitation, those described in: Maliszewski, J. Immunol. 144:3028–3033, 1990; and Assays for B cell function: In vitro antibody production, Mond, J. J. and Brunswick, M. In Current Protocols in Immunology. J. E. e.a. Coligan eds. Vol 1 pp. 3.8.1–3.8.16, John Wiley and Sons, Toronto. 1994.

Mixed lymphocyte reaction (MLR) assays (which will identify, among others, proteins that generate predominantly Th1 and CTL responses) include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 3, In Vitro assays for Mouse Lymphocyte Function 3.1–3.19; Chapter 7, Immunologic studies in Humans); Takai et al., J. Immunol. 137:3494–3500, 1986; Takai et al., J. Immunol. 140:508–512, 1988; Bertagnolli et al., J. Immunol. 149:3778–3783, 1992.

Dendritic cell-dependent assays (which will identify, among others, proteins expressed by dendritic cells that activate naive T-cells) include, without limitation, those described in: Guery et al., J. Immunol. 134:536–544, 1995; Inaba et al., Journal of Experimental Medicine 173:549–559, 1991; Macatonia et al., Journal of Immunology 154:5071–5079, 1995; Porgador et al., Journal of Experimental Medicine 182:255–260, 1995; Nair et al., Journal of Virology 67:4062–4069, 1993; Huang et al., Science 264:961–965, 1994; Macatonia et al., Journal of Experimental Medicine 169:1255–1264, 1989; Bhardwaj et al., Journal of Clinical Investigation 94:797–807, 1994; and Inaba et al., Journal of Experimental Medicine 172:631–640, 1990.

Assays for lymphocyte survival/apoptosis (which will identify, among others, proteins that prevent apoptosis after superantigen induction and proteins that regulate lymphocyte homeostasis) include, without limitation, those described in: Darzynkiewicz et al., Cytometry 13:795–808, 1992; Gorczyca et al., Leukemia 7:659–670, 1993; Gorczyca et al., Cancer Research 53:1945–1951, 1993; Itoh et al., Cell 66:233–243, 1991; Zacharchuk, Journal of Immunology 145:4037–4045, 1990; Zamai et al., Cytometry 14:891–897, 1993; Gorczyca et al., International Journal of Oncology 1:639–648, 1992.

Assays for proteins that influence early steps of T-cell commitment and development include, without limitation, those described in: Antica et al., Blood 84:111–117, 1994; Fine et al., Cellular Immunology 155:111–122, 1994; Galy et al., Blood 85:2770–2778, 1995; Toki et al., Proc. Nat. Acad Sci. USA 88:7548–7551, 1991.

3.10.8 Activin/Inhibin Activity

A polypeptide of the present invention may also exhibit activin- or inhibin-related activities. A polynucleotide of the invention may encode a polypeptide exhibiting such characteristics. Inhibins are characterized by their ability to inhibit the release of follicle stimulating hormone (FSH), while activins and are characterized by their ability to stimulate the release of follicle stimulating hormone (FSH). Thus, a polypeptide of the present invention, alone or in heterodimers with a member of the inhibin family, may be useful as a contraceptive based on the ability of inhibins to decrease fertility in female mammals and decrease spermatogenesis in male mammals. Administration of sufficient amounts of other inhibins can induce infertility in these mammals. Alternatively, the polypeptide of the invention, as a homodimer or as a heterodimer with other protein subunits of the inhibin group, may be useful as a fertility inducing therapeutic, based upon the ability of activin molecules in stimulating FSH release from cells of the anterior pituitary. See, for example, U.S. Pat. No. 4,798,885. A polypeptide of the invention may also be useful for advancement of the onset of fertility in sexually immature mammals, so as to increase the lifetime reproductive performance of domestic animals such as, but not limited to, cows, sheep and pigs.

The activity of a polypeptide of the invention may, among other means, be measured by the following methods.

Assays for activin/inhibin activity include, without limitation, those described in: Vale et al., Endocrinology 91:562–572, 1972; Ling et al., Nature 321:779–782, 1986; Vale et al., Nature 321:776–779, 1986; Mason et al., Nature 318:659–663, 1985; Forage et al., Proc. Natl. Acad. Sci. USA 83:3091–3095, 1986.

3.10.9 Cremotactic/Chemokinetic Activity

A polypeptide of the present invention may be involved in chemotactic or chemokinetic activity for mammalian cells, including, for example, monocytes, fibroblasts, neutrophils, T-cells, mast cells, eosinophils, epithelial and/or endothelial cells. A polynucleotide of the invention can encode a polypeptide exhibiting such attributes. Chemotactic and chemokinetic receptor activation can be used to mobilize or attract a desired cell population to a desired site of action. Chemotactic or chemokinetic compositions (e.g. proteins, antibodies, binding partners, or modulators of the invention) provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or peptide has chemotactic activity for a particular cell population if it can stimulate, directly or indirectly, the directed orientation or movement of such cell population. Preferably, the protein or peptide has the ability to directly stimulate directed movement of cells. Whether a particular protein has chemotactic activity for a population of cells can be readily determined by employing such protein or peptide in any known assay for cell chemotaxis.

Therapeutic compositions of the invention can be used in the following:

Assays for chemotactic activity (which will identify proteins that induce or prevent chemotaxis) consist of assays that measure the ability of a protein to induce the migration of cells across a membrane as well as the ability of a protein to induce the adhesion of one cell population to another cell population. Suitable assays for movement and adhesion include, without limitation, those described in: Current Protocols in Immunology, Ed by J. E. Coligan, A. M. Kruisbeek, D. H. Marguiles, E. M. Shevach, W. Strober, Pub. Greene Publishing Associates and Wiley-Interscience (Chapter 6.12, Measurernent of alpha and beta Chemokines 6.12.1–6.12.28; Taub et al. J. Clin. Invest. 95:1370–1376, 1995; Lind et al. APMIS 103:140–146, 1995; Muller et al Eur. J. Immunol. 25:1744–1748; Gruber et al. J. of Immunol. 152:5860–5867, 1994; Johnston et al. J. of Immunol. 153:1762–1768, 1994.

3.10.10 Hemostatic and Thrombolytic Activity

A polypeptide of the invention may also be involved in hemostatis or thrombolysis or thrombosis. A polynucleotide of the invention can encode a polypeptide exhibiting such attributes. Compositions may be useful in treatment of various coagulation disorders (including hereditary disorders, such as hemophilias) or to enhance coagulation and other hemostatic events in treating wounds resulting from trauma, surgery or other causes. A composition of the invention may also be useful for dissolving or inhibiting formation of thromboses and for treatment and prevention of conditions resulting therefrom (such as, for example, infarction of cardiac and central nervous system vessels (e.g., stroke).

Therapeutic compositions of the invention can be used in the following:

Assay for hemostatic and thrombolytic activity include, without limitation, those described in: Linet et al., J. Clin. Pharmacol. 26:131–140, 1986; Burdick et al., Thrombosis Res. 45:413–419, 1987; Humphrey et al., Fibrinolysis 5:71–79 (1991); Schaub, Prostaglandins 35:467–474, 1988.

3.10.11 Cancer Diagnosis and Therapy

Polypeptides of the invention may be involved in cancer cell generation, proliferation or metastasis. Detection of the presence or amount of polynucleotides or polypeptides of the invention may be useful for the diagnosis and/or prognosis of one or more types of cancer. For example, the presence or increased expression of a polynucleotide/polypeptide of the invention may indicate a hereditary risk of cancer, a precancerous condition, or an ongoing malignancy. Conversely, a defect in the gene or absence of the polypeptide may be associated with a cancer condition. Identification of single nucleotide polymorphisms associated with cancer or a predisposition to cancer may also be useful for diagnosis or prognosis.

Cancer treatments promote tumor regression by inhibiting tumor cell proliferation, inhibiting angiogenesis (growth of new blood vessels that is necessary to support tumor growth) and/or prohibiting metastasis by reducing tumor cell motility or invasiveness. Therapeutic compositions of the invention may be effective in adult and pediatric oncology including in solid phase tumors/malignancies, locally advanced tumors, human soft tissue sarcomas, metastatic cancer, including lymphatic metastases, blood cell malignancies including multiple myeloma, acute and chronic leukemnias, and lymphomas, head and neck cancers including mouth cancer, larynx cancer and thyroid cancer, lung cancers including small cell carcinoma and non-small cell cancers, breast cancers including small cell carcinoma and ductal carcinoma, gastrointestinal cancers including esophageal cancer, stomach cancer, colon cancer, colorectal cancer and polyps associated with colorectal neoplasia, pancreatic cancers, liver cancer, urologic cancers including bladder cancer and prostate cancer, malignancies of the female genital tract including ovarian carcinoma, uterine (including endometrial) cancers, and solid tumor in the ovarian follicle, kidney cancers including renal cell carcinoma, brain cancers including intrinsic brain tumors, neuroblastoma, astrocytic brain tumors, gliomas, metastatic tumor cell invasion in the central nervous system, bone cancers including osteomas, skin cancers including malignant melanoma, tumor progression of human skin keratinocytes, squamous cell carcinoma, basal cell carcinoma, hemangiopericytoma and Karposi's sarcoma.

Polypeptides, polynucleotides, or modulators of polypeptides of the invention (including inhibitors and stimulators of the biological activity of the polypeptide of the invention) may be administered to treat cancer. Therapeutic compositions can be administered in therapeutically effective dosages alone or in combination with adjuvant cancer therapy such as surgery, chemotherapy, radiotherapy, thermotherapy, and laser therapy, and may provide a beneficial effect, e.g. reducing tumor size, slowing rate of tumor growth, inhibiting metastasis, or otherwise improving overall clinical condition, without necessarily eradicating the cancer.

The composition can also be administered in therapeutically effective amounts as a portion of an anti-cancer cocktail. An anti-cancer cocktail is a mixture of the polypeptide or modulator of the invention with one or more anti-cancer drugs in addition to a pharmaceutically acceptable carrier for delivery. The use of anti-cancer cocktails as a cancer treatment is routine. Anti-cancer drugs that are well known in the art and can be used as a treatment in combination with the polypeptide or modulator of the invention include: Actinomycin D, Aminoglutethimide, Asparaginase, Bleomycin, Busulfan, Carboplatin, Carmustine, Chlorambucil, Cisplatin (cis-DDP), Cyclophosphamide, Cytarabine HCl (Cytosine arabinoside), Dacarbazine, Dactinomycin, Daunorubicin HCl, Doxorubicin HCl, Estramustine phosphate sodium, Etoposide (V16–213), Floxuridine, 5-Fluorouracil (5-Fu), Flutamide, Hydroxyurea (hydroxycarbamide), Ifosfamide, Interferon Alpha-2a, Interferon Alpha-2b, Leuprolide acetate (LHRH-releasing factor analog), Lomustine, Mechiorethamnine HCl (nitrogen mustard), Melphalan, Mercaptopurine, Mesna, Methotrexate (MTX), Mitomycin, Mitoxantrone HCl, Octreotide, Plicamycin, Procarbazine HCl, Streptozocin, Tamoxifen citrate, Thioguanine, Thiotepa, Vinblastine sulfate, Vincristine sulfate, Ainsacrinc, Azacitidine, Hexamethylnelamine, Interleukin-2, Mitoguazone, Pentostatin, Semustine, Teniposide, and Vindesine sulfate.

In addition, therapeutic compositions of the invention may be used for prophylactic treatment of cancer. There are hereditary conditions and/or environmental situations (e.g. exposure to carcinogens) known in the art that predispose an individual to developing cancers. Under these circumstances, it may be beneficial to treat these individuals with therapeutically effective doses of the polypeptide of the invention to reduce the risk of developing cancers.

In vitro models can be used to determine the effective doses of the polypeptide of the invention as a potential cancer treatment. These in vitro models include proliferation assays of cultured tumor cells, growth of cultured tumor cells in soft agar (see Freshney, (1987) Culture of Animal Cells: A Manual of Basic Technique, Wily-Liss, New York, N.Y. Ch 18 and Ch 21), tumor systems in nude mice as described in Giovanella et al., J. Natl. Can. Inst., 52: 921–30 (1974), mobility and invasive potential of tumor cells in Boyden Chamber assays as described in Pilkington et al., Anticancer Res., 17: 4107–9 (1997), and angiogenesis assays such as induction of vascularization of the chick chorioallantoic membrane or induction of vascular endothelial cell migration as described in Ribatta et al., Intl. J. Dev. Biol., 40: 1189–97 (1999) and Li et al., Clin. Exp. Metastasis, 17:423–9 (1999), respectively. Suitable tumor cells lines are available, e.g. from American Type Tissue Culture Collection catalogs.

3.10.12 Receptor/Ligand Activity

A polypeptide of the present invention may also demonstrate activity as receptor, receptor ligand or inhibitor or agonist of receptor/ligand interactions. A polynucleotide of the invention can encode a polypeptide exhibiting such characteristics. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as selectins, integrins and their ligands) and receptor/ligand pairs involved in antigen presentation, antigen recognition and development of cellular and humoral immune responses. Receptors and ligands are also useful for screening of potential peptide or small molecule inhibitors of the relevant receptor/ligand interaction. A protein of the present invention (including, without limitation, fragments of receptors and ligands) may themselves be useful as inhibitors of receptor/ligand interactions.

The activity of a polypeptide of the invention may, among other means, be measured by the following methods:

Suitable assays for receptor-ligand activity include without limitation those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 7.28, Measurement of Cellular Adhesion under static conditions 7.28.1–7.28.22), Takai et al., Proc. Natl. Acad. Sci. USA 84:6864–6868, 1987; Bierer et al., J. Exp. Med. 168:1145–1156, 1988; Rosenstein et al., J. Exp. Med. 169:149–160 1989; Stoltenborg et al., J. Immunol. Methods 175:59–68, 1994; Stitt et al., Cell 80:661–670, 1995.

By way of example, the polypeptides of the invention may be used as a receptor for a ligand(s) thereby transmitting the biological activity of that ligand(s). Ligands may be identified through binding assays, affinity chromatography, dihybrid screening assays, BIAcore assays, gel overlay assays, or other methods known in the art.

Studies characterizing drugs or proteins as agonist or antagonist or partial agonists or a partial antagonist require the use of other proteins as competing ligands. The polypeptides of the present invention or ligand(s) thereof may be labeled by being coupled to radioisotopes, colorimetric molecules or a toxin molecules by conventional methods. ("Guide to Protein Purification" Murray P. Deutscher (ed) Methods in Enzymology Vol. 182 (1990) Academic Press, Inc. San Diego). Examples of radioisotopes include, but are not limited to, tritium and carbon-14. Examples of calorimetric molecules include, but are not limited to, fluorescent molecules such as fluorescamine, or rhodamine or other colorimetric molecules. Examples of toxins include, but are not limited, to ricin.

3.10.13 Drug Screening

This invention is particularly useful for screening chemical compounds by using the novel polypeptides or binding fragments thereof in any of a variety of drug screening techniques. The polypeptides or fragments employed in such a test may either be free in solution, affixed to a solid support, borne on a cell surface or located intracellularly. One method of drug screening utilizes eukaryotic or prokaryotic host cells which are stably transformed with recombinant nucleic acids expressing the polypeptide or a fragment thereof. Drugs are screened against such transformed cells in competitive binding assays. Such cells, either in viable or fixed form, can be used for standard binding assays. One may measure, for example, the formation of complexes between polypeptides of the invention or fragments and the agent being tested or examine the diminution in complex formation between the novel polypeptides and an appropriate cell line, which are well known in the art.

Sources for test compounds that may be screened for ability to bind to or modulate (i.e., increase or decrease) the activity of polypeptides of the invention include (1) inorganic and organic chemical libraries, (2) natural product libraries, and (3) combinatorial libraries comprised of either random or mimetic peptides, oligonucleotides or organic molecules.

Chemical libraries may be readily synthesized or purchased from a number of commercial sources, and may include structural analogs of known compounds or compounds that are identified as "hits" or "leads" via natural product screening.

The sources of natural product libraries are microorganisms (including bacteria and fungi), animals, plants or other vegetation, or marine organisms, and libraries of mixtures for screening may be created by: (1) fermentation and extraction of broths from soil, plant or marine microorganisms or (2) extraction of the organisms themselves. Natural product libraries include polyketides, non-ribosomal peptides, and (non-naturally occurring) variants thereof. For a review, see *Science* 282:63–68 (1998).

Combinatorial libraries are composed of large numbers of peptides, oligonucleotides or organic compounds and can be readily prepared by traditional automated synthesis methods, PCR, cloning or proprietary synthetic methods. Of particular interest are peptide and oligonucleotide combinatorial libraries. Still other libraries of interest include peptide, protein, peptidomimetic, multiparallel synthetic collection, recombinatorial, and polypeptide libraries. For a review of combinatorial chemistry and libraries created therefrom, see Myers, *Curr. Opin. Biotechnol.* 8:701–707 (1997). For reviews and examples of peptidomimetic libraries, see Al-Obeidi et al., *Mol. Biotechnol*, 9(3):205–23 (1998); Hrubyet al., *Curr Opin Chem Biol,* 1(1):114–19 (1997); Dorner et al., *Bioorg Med Chem*, 4(5):709–15 (1996) (alkylated dipeptides).

Identification of modulators through use of the various libraries described herein permits modification of the candidate "hit" (or "lead") to optimize the capacity of the "hit" to bind a polypeptide of the invention. The molecules identified in the binding assay are then tested for antagonist or agonist activity in in vivo tissue culture or animal models that are well known in the art. In brief, the molecules are titrated into a plurality of cell cultures or animals and then tested for either cell/animal death or prolonged survival of the animal/cells.

The binding molecules thus identified may be complexed with toxins, e.g., ricin or cholera, or with other compounds that are toxic to cells such as radioisotopes. The toxin-binding molecule complex is then targeted to a tumor or other cell by the specificity of the binding molecule for a polypeptide of the invention. Alternatively, the binding molecules may be complexed with imaging agents for targeting and imaging purposes.

3.10.14 Assay for Receptor Activity

The invention also provides methods to detect specific binding of a polypeptide e.g. a ligand or a receptor. The art provides numerous assays particularly useful for identifying previously unknown binding partners for receptor polypeptides of the invention. For example, expression cloning using mammalian or bacterial cells, or dihybrid screening assays can be used to identify polynucleotides encoding binding partners. As another example, affinity chromatography with the appropriate immobilized polypeptide of the invention can be used to isolate polypeptides that recognize and bind polypeptides of the invention. There are a number of different libraries used for the identification of compounds, and in particular small molecules, that modulate (i.e., increase or decrease) biological activity of a polypeptide of the invention. Ligands for receptor polypeptides of the invention can also be identified by adding exogenous ligands, or cocktails of ligands to two cells populations that are genetically identical except for the expression of the receptor of the invention: one cell population expresses the receptor of the invention whereas the other does not. The response of the two cell populations to the addition of ligands(s) are then compared. Alternatively, an expression library can be co-expressed with the polypeptide of the invention in cells and assayed for an autocrine response to identify potential ligand(s). As still another example, BIAcore assays, gel overlay assays, or other methods known in the art can be used to identify binding partner polypeptides, including, (1) organic and inorganic chemical libraries, (2) natural product libraries, and (3) combinatorial libraries comprised of random peptides, oligonuclcotides or organic molecules.

The role of downstream intracellular signaling molecules in the signaling cascade of the polypeptide of the invention can be determined. For example, a chimeric protein in which the cytoplasmic domain of the polypeptide of the invention is fused to the extracellular portion of a protein, whose ligand has been identified, is produced in a host cell. The cell is then incubated with the ligand specific for the extracellular portion of the chimeric protein, thereby activating the chimeric receptor. Known downstream proteins involved in intracellular signaling can then be assayed for expected modifications i.e. phosphorylation. Other methods known to those in the art can also be used to identify signaling molecules involved in receptor activity.

3.10.15 Anti-inflammatory Activity

Compositions of the present invention may also exhibit anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Compositions with such activities can be used to treat inflammatory conditions including chronic or acute conditions), including without limitation intimation associated with infection (such as septic shock, sepsis or systemic inflammatory response syndrome (SIRS)), ischemia-reperfusion injury, endotoxin lethality, arthritis, complement-mediated hyperacute rejection, nephritis, cytokine or chemokine-induced lung injury, inflammatory bowel disease, Crohn's disease or resulting from over production of cytokines such as TNF or IL-1. Compositions of the invention may also be useful to treat anaphylaxis and hypersensitivity to an antigenic substance or material. Compositions of this invention may be utilized to prevent or treat conditions such as, but not limited to, sepsis, acute pancreatitis, endotoxin shock, cytokine induced shock, rheumatoid arthritis, chronic inflammatory arthritis, pancreatic cell damage from diabetes mellitus type 1, graft versus host disease, inflammatory bowel disease, inflamation associated with pulmonary disease, other autoimmune disease or inflammatory disease, an antiproliferative agent such as for acute or chronic mylegenous leukemia or in the prevention of premature labor secondary to intrauterine infections.

3.10.16 Leukemias

Leukemias and related disorders may be treated or prevented by administration of a therapeutic that promotes or inhibits function of the polynucleotides and/or polypeptides of the invention. Such leukemias and related disorders include but are not limited to acute leukemia, acute lymphocytic leukemia, acute myelocytic leukemia, myeloblastic, promyclocytic, myelomonocytic, monocytic, erythroleukemia, chronic leukemia, chronic myelocytic (granulocytic) leukemia and chronic lymphocytic leukemia (for a review of such disorders, see Fishman et al., 1985, Medicine, 2d Ed., J. B. Lippincott Co., Philadelphia).

3.10.17 Nervous System Disorders

Nervous system disorders, involving cell types which can be tested for efficacy of intervention with compounds that modulate the activity of the polynucleotides and/or polypeptides of the invention, and which can be treated upon thus observing an indication of therapeutic utility, include but are not limited to nervous system injuries, and diseases or disorders which result in either a disconnection of axons, a diminution or degeneration of neurons, or demyelination. Nervous system lesions which may be treated in a patient (including human and non-human mammalian patients) according to the invention include but are not limited to the following lesions of either the central (including spinal cord, brain) or peripheral nervous systems:

(i) traumatic lesions, including lesions caused by physical injury or associated with surgery, for example, lesions which sever a portion of the nervous system, or compression injuries;

(ii) ischemnic lesions, in which a lack of oxygen in a portion of the nervous system results in neuronal injury or death, including cerebral infarction or ischemia, or spinal cord infarction or ischemia;

(iii) infectious lesions, in which a portion of the nervous system is destroyed or injured as a result of infection, for example, by an abscess or associated with infection by human immunodeficiency virus, herpes zoster, or herpes simplex virus or with Lymc disease, tuberculosis, syphilis;

(iv) degenerative lesions, in which a portion of the nervous system is destroyed or injured as a result of a degenerative process including but not limited to degeneration associated with Parkinson's disease, Alzheimer's disease, Huntington's chorea, or amyotrophic lateral sclerosis;

(v) lesions associated with nutritional diseases or disorders, in which a portion of the nervous system is destroyed or injured by a nutritional disorder or disorder of metabolism including but not limited to, vitamin B12 deficiency, folic acid deficiency, Wemicke disease, tobacco-alcohol amblyopia, Marchiafava-Bignami disease (primary degeneration of the corpus callosum), and alcoholic cerebellar degeneration;

(vi) neurological lesions associated with systemic diseases including but not limited to diabetes (diabetic neuropathy, Bell's palsy), systemic lupus erythematosus, carcinoma, or sarcoidosis;

(vii) lesions caused by toxic substances including alcohol, lead, or particular neurotoxins; and (viii) demyelinated lesions in which a portion of the nervous system is destroyed or injured by a demyelinating disease including but not limited to multiple sclerosis, human immunodeficiency virus-associated myelopathy, transverse myelopathy or various etiologies, progressive multifocal leukoencephalopathy, and central pontine myelinolysis.

Therapeutics which are useful according to the invention for treatment of a nervous system disorder may be selected by testing for biological activity in promoting the survival or differentiation of neurons. For example, and not by way of limitation, therapeutics which elicit any of the following effects may be useful according to the invention:

(i) increased survival time of neurons in culture;

(ii) increased sprouting of neurons in culture or in vivo;

(iii) increased production of a neuron-associated molecule in culture or in vivo, e.g., choline acetyltransferase or acetylcholinesterase with respect to motor neurons; or (iv) decreased symptoms of neuron dysfimction in vivo.

Such effects may be measured by any method known in the art. In preferred, non-limiting embodiments, increased survival of neurons may be measured by the method set forth in Arakawa et al. (1990, J. Neurosci. 10:3507–3515); increased sprouting of neurons may be detected by methods set forth in Pestronk et al. (1980, Exp. Neurol. 70:65–82) or Brown et al. (1981, Ann. Rev. Neurosci. 4:1742); increased production of neuron-associated molecules may be measured by bioassay, enzymatic assay, antibody binding, Northern blot assay, etc., depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include but are not limited to disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including but not limited to progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

3.10.18 Other Activities

A polypeptide of the invention may also exhibit one or more of the following additional activities or effects: inhibiting the growth, infection or function of, or killing, infectious agents, including, without limitation, bacteria, viruses, fuingi and other parasites; effecting (suppressing or enhancing) bodily characteristics, including, without limitation, height, weight, hair color, eye color, skin, fat to lean ratio or other tissue pigrnentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, co-factors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein.

3.10.19 Identification of Polymorphisms

The demonstration of polymorphisms makes possible the identification of such polymorphisms in human subjects and the pharmacogenetic use of this information for diagnosis and treatment. Such polymorphisms may be associated with, e.g., differential predisposition or susceptibility to various disease states (such as disorders involving inflammation or immune response) or a differential response to drug admninistration, and this genetic information can be used to tailor preventive or therapeutic treatment appropriately. For example, the existence of a polymorphism associated with a predisposition to inflammation or autoimmune disease makes possible the diagnosis of this condition in humans by identifying the presence of the polymorphism.

Polymorphisms can be identified in a variety of ways known in the art which all generally involve obtaining a sample from a patient, analyzing DNA from the sample, optionally involving isolation or amplification of the DNA, and identifying the presence of the polymorphism in the DNA. For example, PCR may be used to amplify an appropriate fragment of genomic DNA which may then be sequenced. Alternatively, the DNA may be subjected to allele-specific oligonucleotide hybridization (in which appropriate oligonucleotides are hybridized to the DNA under conditions permitting detection of a single base mismatch) or to a single nucleotide extension assay (in which an oligonucleotide that hybridizes immediately adjacent to the position of the polymorphism is extended with one or more labeled nucleotides). In addition, traditional restriction fragment length polymorphism analysis (using restriction enzymes that provide differential digestion of the genomic DNA depending on the presence or absence of the polymorphism) may be performed. Arrays with nucleotide sequences of the present invention can be used to detect polymorphisms. The array can comprise modified nucleotide sequences of the present invention in order to detect the nucleotide sequences of the present invention. In the alternative, any one of the nucleotide sequences of the present invention can be placed on the array to detect changes from those sequences.

Alternatively a polymorphism resulting in a change in the amino acid sequence could also be detected by detecting a corresponding change in amino acid sequence of the protein, e.g., by an antibody specific to the variant sequence. 3.10.20 Arthritis and Inflammation The immunosuppressive effects of the compositions of the invention against rheumatoid arthritis is determined in an experimental animal model system. The experimental model system is adjuvant induced arthritis in rats, and the protocol is described by J. Holoshitz, et at., 1983, Science, 219:56, or by B. Waksman et al., 1963, Int. Arch. Allergy Appl. Immunol., 23:129. Induction of the disease can be caused by a single injection, generally intradermally, of a suspension of killed Mycobacterium tuberculosis in complete Freund's adjuvant (CFA). The route of injection can vary, but rats may be injected at the base of the tail with an adjuvant mixture. The polypeptide is administered in phosphate buffered solution (PBS) at a dose of about 1–5 mg/kg. The control consists of administering PBS only.

The procedure for testing the effects of the test compound would consist of intradermally injecting killed Mycobacterium tuberculosis in CFA followed by immediately administering the test compound and subsequent treatment every other day until day 24. At 14, 15, 18, 20, 22, and 24 days after injection of Mycobacterium CFA, an overall arthritis score may be obtained as described by J. Holoskitz above. An analysis of the data would reveal that the test compound would have a dramatic affect on the swelling of the joints as measured by a decrease of the arthritis score.

3.11 Therapeutic Methods

The compositions (including polypeptide fragments, analogs, variants and antibodies or other binding partners or modulators including antisense polynucleotides) of the invention have numerous applications in a variety of therapeutic methods. Examples of therapeutic applications include, but are not limited to, those exemplified herein.

3.11.1 Example

One embodiment of the invention is the administration of an effective amount of the polypeptides or other composition of the invention to individuals affected by a disease or disorder that can be modulated by regulating the peptides of the invention. While the mode of administration is not particularly important, parenteral administration is preferred. An exemplary mode of administration is to deliver an intravenous bolus. The dosage of the polypeptides or other composition of the invention will normally be determined by the prescribing physician. It is to be expected that the dosage will vary according to the age, weight, condition and response of the individual patient. Typically, the amount of polypeptide administered per dose will be in the range of about 0.01 $\mu$g/kg to 100 mg/kg of body weight, with the preferred dose being about 0.1 $\mu$g/kg to 10 mg/kg of patient body weight. For parenteral administration, polypeptides of the invention will be formulated in an injectable form combined with a pharmaceutically acceptable parenteral vehicle. Such vehicles are well known in the art and examples include water, saline, Ringer's solution, dextrose solution, and solutions consisting of small amounts of the human serum albumin. The vehicle may contain minor amounts of additives that maintain the isotonicity and stability of the polypeptide or other active ingredient. The preparation of such solutions is within the slill of the art.

3.12 Pharmaceutical Formulations and Routes of Administration

A protein or other composition of the present invention (from whatever source derived, including without limitation from recombinant and non-recombinant sources and including antibodies and other binding partners of the polypeptides of the invention) may be administered to a patient in need, by itself, or in pharmaceutical compositions where it is mixed with suitable carriers or excipient(s) at doses to treat or ameliorate a variety of disorders. Such a composition may optionally contain (in addition to protein or other active ingredient and a carrier) diluents, fillers, salts, buffers, stabilizers, solubilizers, and other materials well known in the art. The term "pharmaceutically acceptable" means a non-toxic material that does not interfere with the effectiveness of the biological activity of the active ingredient(s). The characteristics of the carrier will depend on the route of administration. The pharmaceutical composition of the invention may also contain cytokines, lymphokines, or other hematopoietic factors such as M-CSF, GM-CSF, TNF, IL-1, IL-2, IL-3, IL-4, IL-5, IL-6, IL-7, IL-8, IL-9, IL-10, IL-11, IL-12, IL-13, IL-14, IL-15, IFN, TNF0, TNF1, TNF2, G-CSF, Meg-CSF, thrombopoietin, stem cell factor, and erythropoietin. In further compositions, proteins of the invention may be combined with other agents beneficial to the treatment of the disease or disorder in question. These agents include various growth factors such as epidermal growth factor (EGF), platelet-derived growth factor (PDGF), transforming growth factors (TGF-α and TGF-β), insulin-like growth factor (IGF), as well as cytokines described herein.

The pharmaceutical composition may further contain other agents which either enhance the activity of the protein or other active ingredient or complement its activity or use in treatment. Such additional factors and/or agents may be included in the pharmaceutical composition to produce a synergistic effect with protein or other active ingredient of the invention, or to minimize side effects. Conversely, protein or other active ingredient of the present invention may be included in formulations of the particular clotting factor, cytokine, lymphokine, other hematopoietic factor, thrombolytic or anti-thrombotic factor, or anti-inflammatory agent to minimize side effects of the clotting factor, cytokine, lymphokine, other hematopoietic factor, thrombolytic or anti-thrombotic factor, or anti-inflammatory agent (such as IL-1Ra, IL-1 Hy1, IL-1 Hy2, anti-TNF, corticosteroids, immunosuppressive agents). A protein of the present invention may be active in multimers (e.g., heterodimers or homodimers) or complexes with itself or other proteins. As a result, pharmaceutical compositions of the invention may comprise a protein of the invention in such multimeric or complexed form.

As an alternative to being included in a pharmaceutical composition of the invention including a first protein, a second protein or a therapeutic agent may be concurrently administered with the first protein (e.g., at the same time, or at differing times provided that therapeutic concentrations of the combination of agents is achieved at the treatment site). Techniques for formulation and administration of the compounds of the instant application may be found in "Remington's Pharmaceutical Sciences," Mack Publishing Co., Easton, Pa., latest edition. A therapeutically effective dose further refers to that amount of the compound sufficient to result in amelioration of symptoms, e.g., treatment, healing, prevention or amelioration of the relevant medical condition, or an increase in rate of treatment, healing, prevention or amelioration of such conditions. When applied to an individual active ingredient, administered alone, a therapeutically effective dose refers to that ingredient alone. When applied to a combination, a therapeutically effective dose refers to combined amounts of the active ingredients that result in the therapeutic effect, whether administered in combination, serially or simultaneously.

In practicing the method of treatment or use of the present invention, a therapeutically effective amount of protein or other active ingredient of the present invention is administered to a mammal having a condition to be treated. Protein or other active ingredient of the present invention may be administered in accordance with the method of the invention either alone or in combination with other therapies such as treatments employing cytokines, lymphokines or other hematopoietic factors. When co-administered with one or more cytokines, lymphokines or other hematopoiefic factors, protein or other active ingredient of the present invention may be administered either simultaneously with the cytokine(s), lymphokine(s), other hematopoietic factor(s), thrombolytic or anti-thrombotic factors, or sequentially. If administered sequentially, the attending physician will decide on the appropriate sequence of administering protein or other active ingredient of the present invention in combination with cytokine(s), lymphokine(s), other hematopoietic factor(s), thrombolytic or anti-thrombotic factors.

3.12.1 Routes of Administration

Suitable routes of administration may, for example, include oral, rectal, transmucosal, or intestinal administration; parenteral delivery, including intramuscular, subcutaneous, intramedullary injections, as well as intrathecal, direct intraventricular, intravenous, intraperitoneal, intranasal, or intraocular injections. Administration of protein or other active ingredient of the present invention used in the pharmaceutical composition or to practice the method of the present invention can be carried out in a variety of conventional ways, such as oral ingestion, inhalation, topical application or cutaneous, subcutaneous, intraperitoneal, parenteral or intravenous injection. Intravenous administration to the patient is preferred.

Alternately, one may administer the compound in a local rather than systemic manner, for example, via injection of the compound directly into a arthritic joints or in fibrotic tissue, often in a depot or sustained release formulation. In order to prevent the scarring process frequently occurring as complication of glaucoma surgery, the compounds may be administered topically, for example, as eye drops. Furthermore, one may administer the drug in a targeted drug delivery system, for example, in a liposome coated with a specific antibody, targeting, for example, arthritic or fibrotic tissue. The liposomes will be targeted to and taken up selectively by the afflicted tissue.

The polypeptides of the invention are administered by any route that delivers an effective dosage to the desired site of action. The determination of a suitable route of administration and an effective dosage for a particular indication is within the level of skill in the art. Preferably for wound treatment, one administers the therapeutic compound directly to the site. Suitable dosage ranges for the polypeptides of the invention can be extrapolated from these dosages or from similar studies in appropriate animal models. Dosages can then be adjusted as necessary by the clinician to provide maximal therapeutic benefit.

3.12.2 Compositions/Formulations

Pharmaceutical compositions for use in accordance with the present invention thus may be formulated in a conventional manner using one or more physiologically acceptable carriers comprising excipients and auxiliaries which facilitate processing of the active compounds into preparations which can be used pharmaceutically. These pharmaceutical compositions may be manufactured in a manner that is itself known, e.g., by means of conventional mixing, dissolving, granulating, dragee-making, levigating, emulsifying, encapsulating, entrapping or lyophilizing processes. Proper formulation is dependent upon the route of administration chosen. When a therapeutically effective amount of protein or other active ingredient of the present invention is administered orally, protein or other active ingredient of the present invention will be in the form of a tablet, capsule, powder, solution or elixir. When administered in tablet form, the pharmaceutical composition of the invention may additionally contain a solid carrier such as a gelatin or an adjuvant. The tablet, capsule, and powder contain from about 5 to 95% protein or other active ingredient of the present invention, and preferably from about 25 to 90% protein or other active ingredient of the present invention. When administered in liquid form, a liquid carrier such as water, petroleum, oils of animal or plant origin such as peanut oil, mineral oil, soybean oil, or sesame oil, or synthetic oils may be added. The liquid form of the pharmaceutical composition may bather contain physiological saline solution, dextrose or other saccharide solution, or glycols such as ethylene glycol, propylene glycol or polyethylene glycol. When administered in liquid form, the pharmaceutical composition contains from about 0.5 to 90% by weight of protein or other active ingredient of the present invention, and preferably from about 1 to 50% protein or other active ingredient of the present invention.

When a therapeutically effective amount of protein or other active ingredient of the present invention is administered by intravenous, cutaneous or subcutaneous injection, protein or other active ingredient of the present invention will be in the form of a pyrogen-free, parenterally acceptable aqueous solution. The preparation of such parenterally acceptable protein or other active ingredient solutions, having due regard to pH, isotonicity, stability, and the like, is within the skill in the art. A preferred pharmaceutical composition for intravenous, cutaneous, or subcutaneous injection should contain, in addition to protein or other active ingredient of the present invention, an isotonic vehicle such as Sodium Chloride Injection, Ringer's Injection, Dextrose Injection, Dextrose and Sodium Chloride Injection, Lactated Ringer's Injection, or other vehicle as known in the art. The pharmaceutical composition of the present invention may also contain stabilizers, preservatives, buffers, antioxidants, or other additives known to those of skill in the art. For injection, the agents of the invention may be formulated in aqueous solutions, preferably in physiologically compatible buffers such as Hanks's solution, Ringer's solution, or physiological saline buffer. For tarsmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions and the like, for oral ingestion by a patient to be treated. Pharmaceutical preparations for oral use can be obtained from a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carboxymethylcellulose, and/or polyvinylpyrrolidone (PVP). If desired, disintegrating agents may be added, such as the cross-linked polyvinyl pyrrolidone, agar, or alginic acid or a salt thereof such as sodium alginate. Dragee cores are provided with suitable coatings. For this purpose, concentrated sugar solutions may be used, which may optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments may be added to the tablets or dragee coatings for identification or to characterize different combinations of active compound doses.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with filler such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for such administration. For buccal administration, the compositions may take the form of tablets or lozenges formulated in conventional manner.

For administration by inhalation, the compounds for use according to the present invention are conveniently delivered in the form of an aerosol spray presentation from pressurized packs or a nebuliser, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of, e.g., gelatin for use in an inhaler or insufflator may be formulated containing a powder mix of the compound and a suitable powder base such as lactose or starch. The compounds may be formulated for parenteral administration by injection, e.g., by bolus injection or continuous infusion. Formulations for injection may be presented in unit dosage form, e.g., in ampules or in multi-dose containers, with an added preservative. The compositions may take such forms as suspensions, solutions or emulsions in oily or aqueous vehicles, and may contain formulatory agents such as suspending, stabilizing and/or dispersing agents.

Pharmaceutical formulations for parenteral administration include aqueous solutions of the active compounds in water-soluble form. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Aqueous injection suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions. Alternatively, the active ingredient may be in powder form for constitution with a suitable vehicle, e.g., sterile pyrogen-free water, before use.

The compounds may also be formulated in rectal compositions such as suppositories or retention enemas, e.g., containing conventional suppository bases such as cocoa butter or other glycerides. In addition to the formulations described previously, the compounds may also be formulated as a depot preparation. Such long acting formulations may be administered by implantation (for example subcutaneously or intramuscularly) or by intramuscular injection. Thus, for example, the compounds may be formulated with suitable polymeric or hydrophobic materials (for example as an emulsion in an acceptable oil) or ion exchange resins, or as sparingly soluble derivatives, for example, as a sparingly soluble salt.

A pharmaceutical carrier for the hydrophobic compounds of the invention is a co-solvent system comprising benzyl alcohol, a nonpolar surfactant, a water-miscible organic polymer, and an aqueous phase. The co-solvent system may be the VPD co-solvent system. VPD is a solution of 3% w/v benzyl alcohol, 8% w/v of the nonpolar surfactant polysorbate 80, and 65% w/v polyethylene glycol 300, made up to volume in absolute ethanol. The VPD co-solvent system (VPD:5W) consists of VPD diluted 1:1 with a 5% dextrose in water solution. This co-solvent system dissolves hydrophobic compounds well, and itself produces low toxicity upon systemic administration. Naturally, the proportions of a co-solvent system may be varied considerably without destroying its solubility and toxicity characteristics. Furthermnore, the identity of the co-solvent components may be varied: for example, other low-toxicity nonpolar surfactants may be used instead of polysorbate 80; the fraction size of polyethylene glycol may be varied; other biocompatible polymers may replace polyethylene glycol, e.g. polyvinyl pyrrolidone; and other sugars or polysaccharides may substitute for dextrose. Alternatively, other delivery systems for hydrophobic pharmaceutical compounds may be employed. Liposomes and emulsions are well known examples of delivery vehicles or carriers for hydrophobic drugs. Certain organic solvents such as dimethylsulfoxide also may be employed, although usually at the cost of greater toxicity. Additionally, the compounds may be delivered using a sustained-release system, such as semipermeable matrices of solid hydrophobic polymers containing the therapeutic agent. Various types of sustained-release materials have been established and are well known by those skilled in the art. Sustained-release capsules may, depending on their chemical nature, release the compounds for a few weeks up to over 100 days. Depending on the chemical nature and the biological stability of the therapeutic reagent, additional strategies for protein or other active ingredient stabilization may be employed.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols. Many of the active ingredients of the invention may be provided as salts with pharmaceutically compatible counter ions. Such pharmaceutically acceptable base addition salts are those salts which retain the biological effectiveness and properties of the free acids and which are obtained by reaction with inorganic or organic bases such as sodium hydroxide, magnesium hydroxide, ammonia, trialkylamine, dialkylamine, monoalkylamine, dibasic amino acids, sodium acetate, potassium benzoate, triethanol amine and the like.

The pharmaceutical composition of the invention may be in the form of a complex of the protein(s) or other active ingredient(s) of present invention along with protein or peptide antigens. The protein and/or peptide antigen will deliver a stimulatory signal to both B and T lymphocytes. B lymphocytes will respond to antigen through their surface immunoglobulin receptor. T lymphocytes will respond to antigen through the T cell receptor (TCR) following presentation of the antigen by MHC proteins. MHC.and structurally related proteins including those encoded by class I and class II MHC genes on host cells will serve to present the peptide antigen(s) to T lymphocytes. The antigen components could also be supplied as purified MHC-peptide complexes alone or with co-stimulatory molecules that can directly signal T cells. Alternatively antibodies able to bind surface immunoglobulin and other molecules on B cells as well as antibodies able to bind the TCR and other molecules on T cells can be combined with the pharmaceutical composition of the invention The pharmaceutical composition of the invention may be in the form of a liposome in which protein of the present invention is combined, in addition to other pharmaceutically acceptable carriers, with amphipathic agents such as lipids which exist in aggregated form as micelles, insoluble monolayers, liquid crystals, or lamellar layers in aqueous solution. Suitable lipids for liposomal formulation include, without limitation, monoglycerides, diglycerides, sulfatides, lysolecithins, phospholipids, saponin, bile acids, and the like. Preparation of such liposomal formulations is within the level of skill in the art, as disclosed, for example, in U.S. Pat. Nos. 4,235,871; 4,501,728; 4,837,028; and 4,737,323, all of which are incorporated herein by reference.

The amount of protein or other active ingredient of the present invention in the pharmaceutical composition of the present invention will depend upon the nature and severity of the condition being treated, and on the nature of prior treatments which the patient has undergone. Ultimately, the attending physician will decide the amount of protein or other active ingredient of the present invention with which to treat each individual patient. Initially, the attending physician will administer low doses of protein or other active ingredient of the present invention and observe the patient's response. Larger doses of protein or other active ingredient of the present invention may be administered until the optimal therapeutic effect is obtained for the patient, and at that point the dosage is not increased further. It is contemplated that the various pharmaceutical compositions used to practice the method of the present invention should contain about 0.01 $\mu$g to about 100 mg (preferably about 0.1 $\mu$g to about 10 mg, more preferably about 0.1 $\mu$g to about 1 mg) of protein or other active ingredient of the present invention per kg body weight. For compositions of the present invention which are useful for bone, cartilage, tendon or ligament regeneration, the therapeutic method includes administering the composition topically, systematically, or locally as an implant or device. When administered, the therapeutic composition for use in this invention is, of course, in a pyrogen-free, physiologically acceptable form. Further, the composition may desirably be encapsulated or injected in a viscous form for delivery to the site of bone, cartilage or tissue damage. Topical administration may be suitable for wound healing and tissue repair. Therapeutically useful agents other than a protein or other active ingredient of the invention which may also optionally be included in the composition as described above, may alternatively or additionally, be administered simultaneously or sequentially with the composition in the methods of the invention. Preferably for bone and/or cartilage formation, the composition would include a matrix capable of delivering the protein-containing or other active ingredient-containing composition to the site of bone and/or cartilage damage, providing a structure for the developing bone and cartilage and optimally capable of being resorbed into the body. Such matrices may be formed of materials presently in use for other implanted medical applications.

The choice of matrix material is based on biocompatibility, biodegradability, mechanical properties, cosmetic appearance and interface properties. The particular application of the compositions will define the appropriate formulation. Potential matrices for the compositions may be biodegradable and chemically defined calcium sulfate, tricalcium phosphate, hydroxyapatite, polylactic acid, polyglycolic acid and polyanhydrides. Other potential materials are biodegradable and biologically well-defined, such as bone or dermal collagen. Further matrices are comprised of pure proteins or extracellular matrix components. Other potential matrices are nonbiodegradable and chemically defined, such as sintered hydroxyapatite, bioglass, aluminates, or other ceramics. Matrices may be comprised of combinations of any of the above mentioned types of material, such as polylactic acid and hydroxyapatite or collagen and tricalcium phosphate. The bioceramics may be altered in composition, such as in calcium-aluminate-phosphate and processing to alter pore size, particle size, particle shape, and biodegradability. Presently preferred is a 50:50 (mole weight) copolymer of lactic acid and glycolic acid in the form of porous particles having diameters ranging from 150 to 800 microns. In some applications, it will be useful to utilize a sequestering agent, such as carboxymethyl cellulose or autologous blood clot, to prevent the protein compositions from disassociating from the matrix.

A preferred family of sequestering agents is cellulosic materials such as alkylcelluloses (including hydroxyalkylcelluloses), including methylcellulose, ethylcellulose, hydroxyethylcellulose, hydroxypropylcellulose, hydroxypropyl-methylcellulose, and carboxymethylcellulose, the most preferred being cationic salts of carboxymethylcellulose (CMC). Other preferred sequestering agents include hyaluronic acid, sodium alginate, poly(ethylene glycol), polyoxyethylene oxide, carboxyvinyl polymer and poly(vinyl alcohol). The amount of sequestering agent useful herein is 0.5–20 wt %, preferably 1–10 wt % based on total formulation weight, which represents the amount necessary to prevent desorption of the protein from the polymer matrix and to provide appropriate handling of the composition, yet not so much that the progenitor cells are prevented from infiltrating the matrix, thereby providing the protein the opportunity to assist the osteogenic activity of the progenitor cells. In further compositions, proteins or other active ingredients of the invention may be combined with other agents beneficial to the treatment of the bone and/or cartilage defect, wound, or tissue in question. These agents include various growth factors such as epidermal growth factor (EGF), platelet derived growth factor (PDGF), transforming growth factors (TGF-$\alpha$ and TGF-$\beta$), and insulin-like growth factor (IGF).

The therapeutic compositions are also presently valuable for veterinary applications. Particularly domestic animals and thoroughbred horses, in addition to humans, are desired patients for such treatment with proteins or other active ingredients of the present invention. The dosage regimen of a protein-containing pharmaceutical composition to be used in tissue regeneration will be determined by the attending physician considering various factors which modify the action of the proteins, e.g., amount of tissue weight desired to be formed, the site of damage, the condition of the damaged tissue, the size of a wound, type of damaged tissue (e.g., bone), the patient's age, sex, and diet, the severity of any infection, time of administration and other clinical factors. The dosage may vary with the type of matrix used in the reconstitution and with inclusion of other proteins in the pharmaceutical composition. For example, the addition of other known growth factors, such as IGF I (insulin like growth factor I), to the final composition, may also effect the dosage. Progress can be monitored by periodic assessment of tissue/bone growth and/or repair, for example, X-rays, histomorphometric determinations and tetracycline labeling.

Polynucleotides of the present invention can also be used for gene therapy. Such polynucleotides can be introduced either in vivo or ex vivo into cells for expression in a mammalian subject. Polynucleotides of the invention may also be administered by other known methods for introduction of nucleic acid into a cell or organism (including, without limitation, in the form of viral vectors or naked DNA). Cells may also be cultured ex vivo in the presence of proteins of the present invention in order to proliferate or to produce a desired effect on or activity in such cells. Treated cells can then be introduced in vivo for therapeutic purposes.

3.12.3 Effective Dosage

Pharmaceutical compositions suitable for use in the present invention include compositions wherein the active ingredients are contained in an effective amount to achieve its intended purpose. More specifically, a therapeutically effective amount means an amount effective to prevent development of or to alleviate the existing symptoms of the subject being treated. Determination of the effective amount is well within the capability of those skilled in the art, especially in light of the detailed disclosure provided herein. For any compound used in the method of the invention, the therapeutically effective dose can be estimated initially from appropriate in vitro assays. For example, a dose can be formulated in animal models to achieve a circulating concentration range that can be used to more accurately determine useful doses in humans. For example, a dose can be formulated in animal models to achieve a circulating concentration range that includes the $IC_{50}$ as determined in cell culture (i.e., the concentration of the test compound which achieves a half-maximal inhibition of the protein's biological activity). Such information can be used to more accurately determine useful doses in humans.

A therapeutically effective dose refers to that amount of the compound that results in amelioration of symptoms or a prolongation of survival in a patient. Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio between $LD_{50}$ and $ED_{50}$. Compounds which exhibit high therapeutic indices are preferred. The data obtained from these cell culture assays and animal studiescan be used in formulating a range of dosage for use in human. The dosage of such compounds lies preferably within a range of circulating concentrations that include the $ED_{50}$ with little or no toxicity. The dosage may vary within this range depending upon the dosage form employed and the route of administration utilized. The exact formulation, route of administration and dosage can be chosen by the individual physician in view of the patient's condition. See, e.g., Fingl et al., 1975, in "The Pharmacological Basis of Therapeutics", Ch. 1 p.1. Dosage amount and interval may be adjusted individually to provide plasma levels of the active moiety which are sufficient to maintain the desired effects, or minimal effective concentration (MEC). The MEC will vary for each compound but can be estimated from in vitro data Dosages necessary to achieve the MEC will depend on individual characteristics and route of administration. However, HPLC assays or bioassays can be used to determine plasma concentrations.

Dosage intervals can also be determined using MEC value. Compounds should be administered using a regimen which maintains plasma levels above the MEC for 10–90% of the time, preferably between 30–90% and most preferably between 50–90%. In cases of local administration or selective uptake, the effective local concentration of the drug may not be related to plasma concentration.

An exemplary dosage regimen for polypeptides or other compositions of the invention will be in the range of about 0.01 µg/kg to 100 mg/kg of body weight daily, with the preferred dose being about 0.1 µg/kg to 25 mg/kg of patient body weight daily, varying in adults and children. Dosing may be once daily, or equivalent doses may be delivered at longer or shorter intervals.

The amount of composition administered will, of course, be dependent on the subject being treated, on the subject's age and weight, the severity of the affliction, the manner of administration and the judgment of the prescribing physician.

3.12.4 Packaging

The compositions may, if desired, be presented in a pack or dispenser device which may contain one or more unit dosage forms containing the active ingredient. The pack may, for example, comprise metal or plastic foil, such as a blister pack. The pack or dispenser device may be accompanied by instructions for administration. Compositions comprising a compound of the invention formulated in a compatible pharmaceutical carrier may also be prepared, placed in an appropriate container, and labeled for treatment of an indicated condition.

3.13 Antibodies

Also included in the invention are antibodies to proteins, or fragments of proteins of the invention. The term "antibody" as used herein refers to immunoglobulin molecules and immunologically active portions of immunoglobulin (Ig) molecules, i.e., molecules that contain an antigen-binding site that specifically binds (immunoreacts with) an antigen. Such antibodies include, but are not limited to, polyclonal, monoclonal, chimeric, single chain, $F_{ab}$, $F_{ab'}$ and $F_{(ab')2}$ fragments, and an $F_{ab}$ expression library. In general, an antibody molecule obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated related protein of the invention may be intended to serve as an antigen, or a portion or fragment thereof, and additionally can be used as an immunogen to generate antibodies that inmmunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 mino acid residues of the amino acid sequence of the full length protein, such as an amino acid sequence shown in SEQ ID NO: 1–948, and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of alpha-2-macroglobulin-like protein that is located on the surface of the protein, e.g., a hydrophilic region. A hydrophobicity analysis of the human related protein sequence will indicate which regions of a related protein are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each of which is incorporated herein by reference in its entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

The term "specific for" indicates that the variable regions of the antibodies of the invention recognize and bind polypeptides of the invention exclusively (i.e., able to distinguish the polypeptide of the invention from other similar polypeptides despite sequence identity, homology, or similarity found in the family of polypeptides), but may also interact with other proteins (for example, *S. aureus* protein A or other antibodies in ELISA techniques) through interactions with sequences outside the variable region of the antibodies, and in particular, in the constant region of the molecule. Screening assays to determine binding specificity of an antibody of the invention are well known and routinely practiced in the art. For a comprehensive discussion of such assays, see Harlow et al. (Eds), Antibodies A Laboratory Manual; Cold Spring Harbor Laboratory, Cold Spring Harbor, N.Y. (1988), Chapter 6. Antibodies that recognize and bind fragments of the polypeptides of the invention are also contemplated, provided that the antibodies are first and foremost specific for, as defined above, full-length polypeptides of the invention. As with antibodies that are specific for full length polypeptides of the invention, antibodies of the invention that recognize fragments are those which can distinguish polypeptides from the same family of polypeptides despite inherent sequence identity, homology, or similarity found in the family of proteins.

Antibodies of the invention are useful for, for example, therapeutic purposes (by modulating activity of a polypeptide of the invention), diagnostic purposes to detect or quantitate a polypeptide of the invention, as well as purification of a polypeptide of the invention. Kits comprising an antibody of the invention for any of the purposes described herein are also comprehended. In general, a kit of the invention also includes a control antigen for which the antibody is immunospecific. The invention further provides a hybridoma that produces an antibody according to the invention. Antibodies of the invention are useful for detection and/or purification of the polypeptides of the invention.

Monoclonal antibodies binding to the protein of the invention may be useful diagnostic agents for the immunodetection of the protein. Neutralizing monoclonal antibodies binding to the protein may also be useful therapeutics for both conditions associated with the protein and also in the treatment of some forms of cancer where abnormal expression of the protein is involved. In the case of cancerous cells or leukemic cells, neutralizing monoclonal antibodies against the protein may be useful in detecting and preventing the metastatic spread of the cancerous cells, which may be mediated by the protein.

The labeled antibodies of the present invention can be used for in vitro, in vivo, and in situ assays to identify cells or tissues in which a fragment of the polypeptide of interest is expressed. The antibodies may also be used directly in therapies or other diagnostics. The present invention further provides the above-described antibodies immobilized on a solid support. Examples of such solid supports include plastics such as polycarbonate, complex carbohydrates such as agarose and Sepharose®, acrylic resins and such as polyacrylamide and latex beads. Techniques for coupling antibodies to such solid supports are well known in the art (Weir, D. M. et al., "Handbook of Experimental Immunology" 4th Ed., Blackwell Scientific Publications, Oxford, England, Chapter 10 (1986); Jacoby, W. D. et al., Meth. Enzym. 34 Academic Press, N.Y. (1974)). The immobilized antibodies of the present invention can be used for in vitro, in vivo, and in situ assays as well as for immuno-affinity purification of the proteins of the present invention.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow E, and Lane D, 1988, Cold Spring Harbor Laboratory Press, Cold Spring Harbor, N.Y., incorporated herein by reference). Some of these antibodies are discussed below.

3.13.1 Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface-active substances (e.g., lysolecithin, pluronic polyols, polyanions, peptides, oil emulsions, dinitrophenol, etc.), adjuvants usable in humans such as Bacille Calmette-Guerin and Corynebacterium parvum, or similar immunostimulatory agents. Additional examples of adjuvants that can be employed include MPL-TDM adjuvant (monophosphoryl Lipid A, synthetic trehalose dicorynomycolate).

The polyclonal antibody molecules directed against the immunogenic protein can be isolated from the manmmal (e.g., from the blood) and further purified by well known techniques, such as affinity chromatography using protein A or protein G, which provide primarily the IgG faction of immune serum. Subsequently, or alternatively, the specific antigen which is the target of the immunoglobulin sought, or an epitope thereof, may be immobilized on a column to purify the immune specific antibody by immunoaffinity chromatography. Purification of inmmunoglobulins is discussed, for example, by D. Wilkinson (The Scientist, published by The Scientist, Inc., Philadelphia Pa., Vol. 14, No. 8 (Apr. 17, 2000), pp. 25–28).

3.13.2 Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen-binding site capable of immunoreacting with a particular epitope of the antigen characterized by a unique binding affinity for it.

Monoclonal antibodies can be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, *Monoclonal Antibodies: Principles and Practice*, Academic Press, (1986) pp. 59–103). Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies (Kozbor, *J. Immunol.*, 133:3001 (1984); Brodeur et al., *Monoclonal Antibody Production Techniques and Applications*, Marcel Dekker, Inc., New York, (1987) pp. 51–63).

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, *Anal. Biochem.*, 107:220 (1980). Preferably, antibodies having a high degree of specificity and a high binding affinity for the target antigen are isolated.

After the desired hybridoma cells are identified, the clones can be subcloned by limiting dilution procedures and grown by standard methods. Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, *Nature* 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

3.13.3 Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., *Nature*, 321:522–525 (1986); Riechmann et al., *Nature*, 332:323–327 (1988); Verhoeyen et al., *Science*, 239:1534–1536 (1988)), by substituting rodent CDRs or CDR sequences for the corresponding sequences of a human antibody. (See also U.S. Pat. No. 5,225,539). In some instances, Fv framework residues of the human immunoglobulin are replaced by corresponding non-human residues. Humanized antibodies can also comprise residues that are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr. Op. Struct. Biol.*, 2:593–596 (1992)).

3.13.4 Human Antibodies

Fully human antibodies relate to antibody molecules in which essentially the entire sequences of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.*, 227:381 (1991); Marks et al., *J. Mol. Biol.*, 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in Marks et al. (*Bio/Technology* 10, 779–783 (1992)); Lonberg et al. (*Nature* 368 856–859 (1994)); Morrison (Nature 368, 812–13 (1994)); Fishwild et al, (*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using taansgenic nonhuman animals that are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells that secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an imnmunogen, and a correlative method for selecting an antibody that binds immunospecifically to the relevant epitope with high affinity, are disclosed in PCT publication WO 99/53049.

3.13.5 Fab Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

3.13.6 Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-exprcssion of two immunoglobulin heavyhain/light-chain pairs, where the two heavy chains have different specificities (Milstein and Cuello, *Nature*, 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Traunecker et al., 1991 *EMBO J.*, 10:3655–3659.

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology*, 121:210 (1986).

According to another approach described in WO 96/27011, the interface between a pair of antibody molecules can be engineered to maximize the percentage of heterodimers that are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from *E. coli* and chemically coupled to form bispecific antibodies. Shalaby et al., *J. Exp. Med.* 175:217–225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., *J. Immunol.* 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a lighthain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (Fc R), such as Fc RI (CD64), Fe RII (CD32) and Fc RIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor TF).

3.13.7 Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

3.13.8 Effector Function Engineering

It can be desirable to modify the antibody of the invention with respect to effector function, so as to enhance, e.g., the effectiveness of the antibody in treating cancer. For example, cysteine residue(s) can be introduced into the Fe region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., J. Exp Med., 176: 1191–1195 (1992) and Shopes, J. Imunol., 148: 2918–2922 (1992). Homodimeric antibodies with enhanced anti-tumor activity can also be prepared using heterobifunctional cross-linkers as described in Wolff et al. Cancer Research, 53: 2560–2565 (1993). Alternatively, an antibody can be engineered that has dual Fc regions and can thereby have enhanced complement lysis and ADCC capabilities. See Stevenson et al., Anti-Cancer Drug Design, 3: 219–230 (1989).

3.13.9 Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}Bi$, $^{131}I$, $^{131}In$, $^{90}y$, and $^{186}Re$.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (pazidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

3.14 Computer Readable Sequences

In one application of this embodiment, a nucleotide sequence of the present invention can be recorded on computer readable media. As used herein, "computer readable media" refers to any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention. As used herein, "recorded" refers to a process for storing information on computer readable medium. A skilled artisan can readily adopt any of the presently known methods for recording information on computer readable medium to generate manufactures comprising the nucleotide sequence information of the present invention.

A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing any of the nucleotide sequences SEQ ID NOs: 1–948 or a representative fragment thereof; or a nucleotide sequence at least 95% identical to any of the nucleotide sequences of SEQ ID NOs: 1–948 in computer readable form, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., J. Mol. Biol. 215:403–410 (1990)) and BLAZE (Brutlag et al., Comp. Chem. 17:203–207 (1993)) search algorithms on a Sybase system is used to identify open reading frames (ORFs) within a nucleic acid sequence. Such ORFs may be protein encoding fragments and may be useful in producing commercially important proteins such as enzymes used in fermentation reactions and in the production of commercially useful metabolites.

As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based systems are suitable for use in the present invention. As stated above, the computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of a known sequence which match a particular target sequence or target motif A variety of known algorithms are disclosed publicly and a variety of commercially available software for conducting search means are and can be used in the computer-based systems of the present invention. Examples of such software includes, but is not limited to, Smnith-Waterman, MacPattern (EMBL), BLASTN and BLASTA (NPOLYPEPTIDEIA). A skilled artisan can readily recognize that any one of the available algorithms or implementing software packages for conducting homology searches can be adapted for use in the present computer-based systems. As used herein, a "target sequence" can be any nucleic acid or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 300 amino acids, more preferably from about 30 to 100 nucleotide residues. However, it is well recognized that searches for commercially important fragments, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences. Nucleic acid target motifs include, but are not limited to, promoter sequences, hairpin structures and inducible expression elements (protein binding sequences).

3.15 Triple Helix Formation

In addition, the fragments of the present invention, as broadly described, can be used to control gene expression through triple helix formation or antisense DNA or RNA, both of which methods are based on the binding of a polynucleotide sequence to DNA or RNA. Polynucleotides suitable for use in these methods are preferably 20 to 40 bases in length and are designed to be complementary to a region of the gene involved in transcription (triple helix—see Lee et al., Nucl. Acids Res. 6:3073 (1979); Cooney et al., Science 15241:456 (1988); and Dervan et al., Science 251:1360 (1991)) or to the mRNA itself (antisense—Olmno, J. Neurochem. 56:560 (1991); Oligodeoxynucleotides as Antisense Inhibitors of Gene Expression, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide.

3.16 Diagnostic Assays and Kits

The present invention further provides methods to identify the presence or expression of one of the ORFs of the present invention, or homolog thereof, in a test sample, using a nucleic acid probe or antibodies of the present invention, optionally conjugated or otherwise associated with a suitable label.

In general, methods for detecting a polynucleodide of the invention can comprise contacting a sample with a compound that binds to and forms a complex with the polynucleotide for a period sufficient to form the complex, and detecting the complex, so that if a complex is detected, a polynucleotide of the invention is detected in the sample. Such methods can also comprise contacting a sample under stringent hybridization conditions with nucleic acid primers that anneal to a polynucleotide of the invention under such conditions, and amplifying annealed polynucleotides, so that if a polynucleotide is amplified, a polynucleotide of the invention is detected in the sample.

In general, methods for detecting a polypeptide of the invention can comprise contacting a sample with a compound that binds to and forms a complex with the polypeptide for a period sufficient to form the complex, and detecting the complex, so that if a complex is detected, a polypeptide of the invention is detected in the sample.

In detail, such methods comprise incubating a test sample with one or more of the antibodies or one or more of the nucleic acid probes of the present invention and assaying for binding of the nucleic acid probes or antibodies to components within the test sample.

Conditions for incubating a nucleic acid probe or antibody with a test sample vary. Incubation conditions depend on the format employed in the assay, the detection methods employed, and the type and nature of the nucleic acid probe or antibody used in the assay. One skilled in the art will recognize that any one of the commonly available hybridization, amplification or immunological assay formats can readily be adapted to employ the nucleic acid probes or antibodies of the present invention. Examples of such assays can be found in Chard, T., An Introduction to Radioimmunoassay and Related Techniques, Elsevier Science Publishers, Amsterdam, The Netherlands (1986); Bullock, G. R. et al., Techniques in Immunocytochemistry, Academic Press, Orlando, Fla. Vol. 1 (1982), Vol. 2 (1983), Vol. 3 (1985); Tijssen, P., Practice and Theory of immunoassays: Laboratory Techniques in Biochemistry and Molecular Biology, Elsevier Science Publishers, Amsterdam, The Netherlands (1985). The test samples of the present invention include cells, protein or membrane extracts of cells, or biological fluids such as sputum, blood, serum, plasma, or urine. The test sample used in the above-described method will vary based on the assay format, nature of the detection method and the tissues, cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention. Specifically, the invention provides a compartment kit to receive, in close confinement, one or more containers which comprises: (a) a first container comprising one of the probes or antibodies of the present invention; and (b) one or more other containers comprising one or more of the following: wash reagents, reagents capable of detecting presence of a bound probe or antibody.

In detail, a compartment kit includes any kit in which reagents are contained in separate containers. Such containers include small glass containers, plastic containers or strips of plastic or paper. Such containers allows one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody or probe. Types of detection reagents include labeled nucleic acid probes, labeled secondary antibodies, or in the alternative, if the primary antibody is labeled, the enzymatic, or antibody binding reagents which are capable of reacting with the labeled antibody. One skilled in the art will readily recognize that the disclosed probes and antibodies of the present invention can be readily incorporated into one of the established kit formats which are well known in the art.

3.17 Medical Imaging

The novel polypeptides and binding partners of the invention are useful in medical imaging of sites expressing the molecules of the invention (e.g., where the polypeptide of the invention is involved in the immune response, for imaging sites of inflammation or infection). See, e.g., Kunkel et al., U.S. Pat. No. 5,413,778. Such methods involve chemical attachment of a labeling or imaging agent, administration of the labeled polypeptide to a subject in a pharmaceutically acceptable carrier, and imaging the labeled polypeptide in vivo at the target site.

3.18 Screening Assays

Using the isolated proteins and polynucleotides of the invention, the present invention further provides methods of obtaining and identifying agents which bind to a polypeptide encoded by an ORF corresponding to any of the nucleotide sequences set forth in SEQ ID NOs: 1–948, or bind to a specific domain of the polypeptide encoded by the nucleic acid. In detail, said method comprises the steps of:

(a) contacting an agent with an isolated protein encoded by an ORF of the present invention, or nucleic acid of the invention; and (b) determining whether the agent binds to said protein or said nucleic acid.

In general, therefore, such methods for identifying compounds that bind to a polynucleotide of the invention can comprise contacting a compound with a polynucleotide of the invention for a time sufficient to form a polynucleotide/compound complex, and detecting the complex, so that if a polynucleotide/compound complex is detected, a compound that binds to a polynucleotide of the invention is identified.

Likewise, in general, therefore, such methods for identifying compounds that bind to a polypeptide of the invention can comprise contacting a compound with a polypeptide of the invention for a time sufficient to form a polypeptide/compound complex, and detecting the complex, so that if a polypeptide/compound complex is detected, a compound that binds to a polynucleotide of the invention is identified.

Methods for identifying compounds that bind to a polypeptide of the invention can also comprise contacting a compound with a polypeptide of the invention in a cell for a time sufficient to form a polypeptide/compound complex, wherein the complex drives expression of a receptor gene sequence in the cell, and detecting the complex by detecting reporter gene sequence expression, so that if a polypeptide/compound complex is detected, a compound that binds a polypeptide of the invention is identified.

Compounds identified via such methods can include compounds which modulate the activity of a polypeptide of the invention (that is, increase or decrease its activity, relative to activity observed in the absence of the compound). Alternatively, compounds identified via such methods can include compounds which modulate the expression of a polynucleotide of the invention (that is, increase or decrease expression relative to expression levels observed in the absence of the compound). Compounds, such as compounds identified via the methods of the invention, can be tested using standard assays well known to those of skill in the art for their ability to modulate activity/expression.

The agents screened in the above assay can be, but are not limited to, peptides, carbohydrates, vitamin derivatives, or other pharmaceutical agents. The agents can be selected and screened at random or rationally selected or designed using protein modeling techniques.

For random screening, agents such as peptides, carbohydrates, pharmaceutical agents and the like are selected at random and are assayed for their ability to bind to the protein encoded by the ORF of the present invention. Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like, capable of binding to a specific peptide sequence, in order to generate rationally designed antipeptide peptides, for example see Hurby et al., Application of Synthetic Peptides: Antisense Peptides," In Synthetic Peptides, A User's Guide, W. H. Freeman, NY (1992), pp. 289–307, and Kaspczak et al., Biochemistry 28:9230–8 (1989), or pharmaceutical agents, or the like.

In addition to the foregoing, one class of agents of the present invention, as broadly described, can be used to control gene expression through binding to one of the ORFs or EMFs of the present invention. As described above, such agents can be randomly screened or rationally designed/selected. Targeting the ORF or EMF allows a skilled artisan to design sequence specific or element specific agents, modulating the expression of either a single ORF or multiple ORFs which rely on the same EMF for expression control. One class of DNA binding agents are agents which contain base residues which hybridize or form a triple helix formation by binding to DNA or RNA. Such agents can be based on the classic phosphodiester, ribonucleic acid backbone, or can be a variety of sulfliydryl or polymeric derivatives which have base attachment capacity.

Agents suitable for use in these methods preferably contain 20 to 40 bases and are designed to be complementary to a region of the gene involved in transcription (triple helix—see Lee et al., Nucl. Acids Res. 6:3073 (1979); Cooney et al., Science 241:456 (1988); and Dervan et al., Science 251:1360 (1991)) or to the mRNA itself (antisense—Okano, J. Neurochem. 56:560 (1991); Oligodeoxynucleotides as Antisense Inhibitors of Gene Expression, CRC Press, Boca Raton, Fla. (1988)). Triple helix-formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention is necessary for the design of an antisense or triple helix oligonucleotide and other DNA binding agents.

Agents which bind to a protein encoded by one of the ORFs of the present invention can be used as a diagnostic agent. Agents which bind to a protein encoded by one of the ORFs of the present invention can be formulated using known techniques to generate a pharmaceutical composition.

3.19 Use of Nucleic Acids as Probes

Another aspect of the subject invention is to provide for polypeptide-specific nucleic acid hybridization probes capable of hybridizing with naturally occurring nucleotide sequences. The hybridization probes of the subject invention may be derived from any of the nucleotide sequences SEQ ID NOs: 1–948. Because the corresponding gene is only expressed in a limited number of tissues, a hybridization probe derived from of any of the nucleotide sequences SEQ ID NOs: 1–948 can be used as an indicator of the presence of RNA of cell type of such a tissue in a sample.

Any suitable hybridization technique can be employed, such as, for example, in situ hybridization. PCR as described in U.S. Pat. Nos. 4,683,195 and 4,965,188 provides additional uses for oligonucleotides based upon the nucleotide sequences. Such probes used in PCR may be of recombinant origin, may be chemically synthesized, or a mixture of both. The probe will comprise a discrete nucleotide sequence for the detection of identical sequences or a degenerate pool of possible sequences for identification of closely related genomic sequences.

Other means for producing specific hybridization probes for nucleic acids include the cloning of nucleic acid sequences into vectors for the production of mRNA probes. Such vectors are known in the art and are commercially available and may be used to synthesize RNA probes in vitro by means of the addition of the appropriate RNA polymerase as T7 or SP6 RNA polymerase and the appropriate radioactively labeled nucleotides. The nucleotide sequences may be used to construct hybridization probes for mapping their respective genomic sequences. The nucleotide sequence provided herein may be mapped to a chromosome or specific regions of a chromosome using well known genetic and/or chromosomal mapping techniques. These techniques include in situ hybridization, linkage analysis against known chromosomal markers, hybridization screening with libraries or flow-sorted chromosomal preparations specific to known chromosomes, and the like. The technique of fluorescent in situ hybridization of chromosome spreads has been described, among other places, in Verma et al (1988) Human Chromosomes: A Manual of Basic Techniques, Pergamon Press, New York N.Y.

Fluorescent in situ hybridization of chromosomal preparations and other physical chromosome mapping techniques may be correlated with additional genetic map data. Examples of genetic map data can be found in the 1994 Genome Issue of Science (265:1981f). Correlation between the location of a nucleic acid on a physical chromosomal map and a specific disease (or predisposition to a specific disease) may help delimit the region of DNA associated with that genetic disease. The nucleotide sequences of the subject invention may be used to detect differences in gene sequences between normal, carrier or affected individuals.

3.20 Preparation of Support Bound Oligonucleotides

Oligonucleotides, i.e., small nucleic acid segments, may be readily prepared by, for example, directly synthesizing the oligonucleotide by chemical means, as is commonly practiced using an automated oligonucleotide synthesizer.

Support bound oligonucleotides may be prepared by any of the methods known to those of skill in the art using any suitable support such as glass, polystyrene or Teflon. One strategy is to precisely spot oligonucleotides synthesized by standard synthesizers. Inmobilization can be achieved using passive adsorption (Inouye & Hondo, (1990) J. Clin. Microbiol. 28(6) 1469–72); using UV light (Nagata et al., 1985; Dahlen et al., 1987; Morrissey & Collins, (1989) Mol. Cell Probes 3(2) 189–207) or by covalent binding of base modified DNA (Keller et al., 1988; 1989); all references being specifically incorporated herein.

Another strategy that may be employed is the use of the strong biotin-streptavidin interaction as a linker. For example, Broude et a. (1994) Proc. Natl. Acad. Sci. USA 91(8) 3072–6, describe the use of biotinylated probes, although these are duplex probes, that are immobilized on streptavidin-coated magnetic beads. Streptavidin-coated beads may be purchased from Dynal, Oslo. Of course, this same linking chemistry is applicable to coating any surface with streptavidin. Biotinylated probes may be purchased from various sources, such as, e.g., Operon Technologies (Alameda, Calif.).

Nunc Laboratories (Naperville, Ill.) is also selling suitable material that could be used. Nunc Laboratories have developed a method by which DNA can be covalently bound to the microwell surface termed Covalink NH. CovaLink NH is a polystyrene surface grafted with secondary amino groups (>NH) that serve as bridge-heads for further covalent coupling. CovaLink Modules may be purchased from Nunc Laboratories. DNA molecules may be bound to CovaLink exclusively at the 5'-end by a phosphoramidate bond, allowing immobilization of more than 1 pmol of DNA (Rasmussen et al., (1991) Anal. Biochem. 198(1) 138–42).

The use of CovaLink NH strips for covalent binding of DNA molecules at the 5'-end has been described (Rasmussen et al., (1991). In this technology, a phosphoramidate bond is employed (Chu et al., (1983) Nucleic Acids Res. 11(8) 6513–29). This is beneficial as immobilization using only a single covalent bond is preferred. The phosphoramnidate bond joins the DNA to the CovaLink NH secondary amino groups that are positioned at the end of spacer arms covalently grafted onto the polystyrene surface through a 2 nm long spacer arm. To link an oligonucleotide to CovaLink NH via an phosphoramidate bond, the oligonucleotide terminus must have a 5'-end phosphate group. It is, perhaps, even possible for biotin to be covalently bound to CovaLink and then streptavidin used to bind the probes.

More specifically, the linkage method includes dissolving DNA in water (7.5 ng/ul) and denaturing for 10 min. at 95° C. and cooling on ice for 10 min. Ice-cold 0.1 M 1-methylimidazole, pH 7.0 (1-MeIm$_7$), is then added to a final concentration of 10 mM 1-MeIm$_7$. A ss DNA solution is then dispensed into CovaLink NH strips (75 ul/well) standing on ice.

Carbodiimide 0.2 M 1-ethyl-3-(3-dimethylaminopropyl)-carbodiimide (EDC), dissolved in 10 mM 1-MeIm$_7$, is made fresh and 25 ul added per well. The strips are incubated for 5 hours at 50° C. After incubation the strips are washed using, e.g., Nunc-Immuno Wash; first the wells are washed 3 times, then they are soaked with washing solution for 5 min., and finally they are washed 3 times (where in the washing solution is 0.4 N NaOH, 0.25% SDS heated to 50° C.).

It is contemplated that a further suitable method for use with the present invention is that described in PCT Patent Application WO 90/03382 (Southern & Maskos), incorporated herein by reference. This method of preparing an oligonucleotide bound to a support involves attaching a nucleoside 3'-reagent through the phosphate group by a covalent phosphodiester link to aliphatic hydroxyl groups carried by the support. The oligonucleotide is then synthesized on the supported nucleoside and protecting groups removed from the synthetic oligonucleotide chain under standard conditions that do not cleave the oligonucleotide from the support. Suitable reagents include nucleoside phosphoramidite and nucleoside hydrogen phosphorate.

An on-chip strategy for the preparation of DNA probe for the preparation of DNA probe arrays may be employed. For example, addressable laser-activated photodeprotection may be employed in the chemical synthesis of oligonucleotides directly on a glass surface, as described by Fodor et al. (1991) Science 251(4995) 767–73, incorporated herein by reference. Probes may also be immobilized on nylon supports as described by Van Ness et al. (1991) Nucleic Acids Res. 19(12) 3345–50; or linked to Teflon using the method of Duncan & Cavalier (1 988) Anal. Biochem. 169(1) 104–8; all references being specifically incorporated herein.

To link an oligonucleotide to a nylon support, as described by Van Ness et al. (1991), requires activation of the nylon surface via alkylation and selective activation of the 5'-amine of oligonucleotides with cyanuric chloride.

One particular way to prepare support bound oligonucleotides is to utilize the light-generated synthesis described by Pease et al., (1994) PNAS USA 91(11) 5022–6, incorporated herein by reference). These authors used current photolithographic techniques to generate arrays of immobilized oligonucleotide probes (DNA chips). These methods, in which light is used to direct the synthesis of oligonucleotide probes in high-density, miniaturized arrays, utilize photolabile 5'-protected N-acyl-deoxynucleoside phosphoramidites, surface linker chemistry and versatile combinatorial synthesis strategies. A matrix of 256 spatially defined oligonucleotide probes may be generated in this manner.

3.21 Preparation of Nucleic Acid Fragments

The nucleic acids may be obtained from any appropriate source, such as cDNAs, genomic DNA, chromosomal DNA, iicrodissected chromosome bands, cosmid or YAC inserts, and RNA, including mRNA without any amplification steps. For example, Sambrook et al. (1989) describes three protocols for the isolation of high molecular weight DNA from mammalian cells (p. 9.14–9.23).

DNA fragments may be prepared as clones in M13, plasmid or lambda vectors and/or prepared directly from genomic DNA or cDNA by PCR or other amplification methods. Samples may be prepared or dispensed in multi-well plates. About 100–1000 ng of DNA samples may be prepared in 2–500 ml of final volume.

The nucleic acids would then be fragmented by any of the methods known to those of slill in the art including, for example, using restriction enzymes as described at 9.24–9.28 of Sambrook et al. (1989), shearing by ultrasound and NaOH treatment.

Low pressure shearing is also appropriate, as described by Schriefer et al. (1990) Nucleic Acids Res. 18(24) 7455–6, incorporated herein by reference). In this method, DNA samples are passed through a small French pressure cell at a variety of low to intermediate pressures. A lever device allows controlled application of low to intermediate pressures to the cell. The results of these studies indicate that low-pressure shearing is a useful alternative to sonic and enzymatic DNA iragmentation methods.

One particularly suitable way for fragmenting DNA is contemplated to be that using the two base recognition endonuclease, CviJI, described by Fitzgerald et al. (1992) Nucleic Acids Res. 20(14) 3753–62. These authors described an approach for the rapid fragmentation and fractionation of DNA into particular sizes that they contemplated to be suitable for shotgun cloning and sequencing.

The restriction endonuclease CviJI normally cleaves the recognition sequence PuGCPy between the G and C to leave blunt ends. Atypical reaction conditions, which alter the specificity of this enzyme (CviJI), yield a quasi-random distribution of DNA fragments form the small molecule pUC19 (2688 base pairs). Fitzgerald et al. (1992) quantitatively evaluated the randomness of this fragmentation strategy, using a CviJI digest of pUC19 that was size fractionated by a rapid gel filtration method and directly ligated, without end repair, to a lac Z minus M13 cloning vector. Sequence analysis of 76 clones showed that CviJI** restricts pyGCPy and PuGCPu, in addition to PuGCPy sites, and that new sequence data is accumulated at a rate consistent with random fragmentation.

As reported in the literature, advantages of this approach compared to sonication and agarose gel fractionation include: smaller amounts of DNA are required (0.2–0.5 ug instead of 2–5 ug); and fewer steps are involved (no preligation, end repair, chemical extraction, or agarose gel electrophoresis and elution are needed Irrespective of the manner in which the nucleic acid fragments are obtained or prepared, it is important to denature the DNA to give single stranded pieces available for hybridization. This is achieved by incubating the DNA solution for 2–5 minutes at 80–90° C. The solution is then cooled quickly to 2° C. to prevent renaturation of the DNA fragments before they are contacted with the chip. Phosphate groups must also be removed from genomic DNA by methods known in the art.

3.22 Preparation of DNA Arrays

Arrays may be prepared by spotting DNA samples on a support such as a nylon membrane. Spotting may be performed by using arrays of metal pins (the positions of which correspond to an array of wells in a microtiter plate) to repeated by transfer of about 20 nl of a DNA solution to a nylon membrane. By offset printing, a density of dots higher than the density of the wells is achieved. One to 25 dots may be accommodated in 1 mm², depending on the type of label used. By avoiding spotting in some preselected number of rows and columns, separate subsets (subarrays) may be formed. Samples in one subarray may be the same genomic segment of DNA (or the same gene) from different individuals, or may be different, overlapped genomic clones. Each of the subarrays may represent replica spotting of the same samples. In one example, a selected gene segment may be amplified from 64 patients. For each patient, the amplified gene segment may be in one 96-well plate (all 96 wells containing the same sample). A plate for each of the 64 patients is prepared. By using a 96-pin device, all samples may be spotted on one 8×12 cm membrane. Subarrays may contain 64 samples, one from each patient. Where the 96 subarrays are identical, the dot span may be 1 mm² and there may be a 1 mm space between subarrays.

Another approach is to use membranes or plates (available from NUNC, Naperville, Ill.) which may be partitioned by physical spacers e.g. a plastic grid molded over the membrane, the grid being similar to the sort of membrane applied to the bottom of multiwell plates, or hydrophobic strips. A fixed physical spacer is not preferred for imaging by exposure to flat phosphor-storage screens or x-ray films.

The present invention is illustrated in the following examples. Upon consideration of the present disclosure, one of skill in the art will appreciate that many other embodiments and variations may be made in the scope of the present invention. Accordingly, it is intended that the broader aspects of the present invention not be limited to the disclosure of the following examples. The present invention is not to be limited in scope by the exemplified embodiments which are intended as illustrations of single aspects of the invention, and compositions and methods which are functionally equivalent are within the scope of the invention. Indeed, numerous modifications and variations in the practice of the invention are expected to occur to those skilled in the art upon consideration of the present preferred embodiments. Consequently, the only limitations which should be placed upon the scope of the invention are those which appear in the appended claims.

All references cited within the body of the instant specification are hereby incorporated by reference in their entirety.

4.0 EXAMPLES 4.1 Example 1

Novel Nucleic Acid Sequences Obtained from Various Libraries

A plurality of novel nucleic acids were obtained from cDNA libraries prepared from various human tissues and in some cases isolated from a genomic library derived from human chromosome using standard PCR, SBH sequence signature analysis and Sanger sequencing techniques. The inserts of the library were amplified with PCR using primers specific for the vector sequences which flank the inserts. Clones from cDNA libraries were spotted on nylon membrane filters and screened with oligonucleotide probes (e.g., 7-mers) to obtain signature sequences. The clones were clustered into groups of similar or identical sequences. Representative clones were selected for sequencing.

In some cases, the 5' sequence of the amplified inserts was then deduced using a typical Sanger sequencing protocol. PCR products were purified and subjected to fluorescent dye terminator cycle sequencing. Single pass gel sequencing was done using a 377 Applied Biosystems (ABI) sequencer to obtain the novel nucleic acid sequences. In some cases RACE (Random Amplification of cDNA Ends) was performed to further extend the sequence in the 5' direction.

4.2 Example 2

Novel Nucleic Acids

The novel nucleic acids of the present invention of the invention were assembled from sequences that were obtained from a cDNA library by methods described in Example 1 above, and in some cases sequences obtained from one or more public databases, The nucleic acids were assembled using an EST sequence as a seed. Then a recursive algorithm was used to extend the seed EST into an extended assemblage, by pulling additional sequences from different databases (i.e., Hyseq's database containing EST sequences, dbEST version 119, gb pri 119, and UniGene version 119) that belong to this assemblage. The algorithm terminated when there was no additional sequences from the above databases that would extend the assemblage. Inclusion of component sequences into the assemblage was based on a BLASTN hit to the extending assemblage with BLAST score greater than 300 and percent identity greater than 95%.

Using PHRAP (Univ. of Washington) or CAP4 (Paracel), a full length gene cDNA sequence and its corresponding protein sequence were generated from the assemblage. Any frame shifts and incorrect stop codons were corrected by hand editing. During editing, the sequence was checked using FASTY and/or BLAST against Genbank (i.e., dbEST version 121, gb pri 121, UniGene version 121, Genpept release 121). Other computer programs which may have been used in the editing process were phredPhrap and Consed (University of Washington) and ed-ready, ed-ext and cg-zip-2 (Hyseq, Inc.). The full-length nucleotide and amino acid sequences, including splice variants resulting from these procedures are shown in the Sequence Listing as SEQ ID NO: 1–948.

Table 1 shows the various tissue sources of SEQ ID NO: 1–948.

The homology for SEQ ID NO: 1–948 were obtained by a BLASTP version 2.0al 19MP-WashU search against Genpept release 120 and the amino acid version of Geneseq released on Oct. 26, 2000, using BLAST algorithm. The results showed homologues for SEQ ID NO: 1–948 from Genpept. The homologues with identifiable functions for SEQ ID NO: 1–948 are shown in Table 2 below.

Using eMatrix software package (Stanford University, Stanford, Calif.) (Wu et al., J. Comp. Biol., Vol. 6 pp. 219–235 (1999) herein incorporated by reference), all the sequences were examined to determine whether they had identifiable signature regions. Table 3 shows the signature region found in the indicated polypeptide sequences, the description of the signature, the eMatrix p-value(s) and the position(s) of the signature within the polypeptide sequence.

Using the pFam software program (Sonnhammer et al., Nucleic Acids Res., Vol. 26(1) pp. 320–322 (1998) herein incorporated by reference) all the polypeptide sequences were examined for domains with homology to certain peptide domains. Table 4 shows the name of the domain found, the description, the p-value and the pFam score for the identified domain within the sequence.

The nucleotide sequence within the sequences that codes for signal peptide sequences and their cleavage sites can be determined from using Neural Network SignalP V1.1 program (from Center for Biological Sequence Analysis, The Technical University of Denmark). The process for identifying prokaryotic and eukaryotic signal peptides and their cleavage sites are also disclosed by Henrik Nielson, Jacob Engelbrecht, Soren Brunak, and Gunnar von Heijne in the publication "Identification of prokaryotic and eukaryotic signal peptides and prediction of their cleavage sites" Protein Engineering, Vol. 10, no. 1, pp. 1–6 (1997), incorporated herein by reference. A maximum S score and a mean S score, as described in the Nielson et as reference, was obtained for the polypeptide sequences. Table 5 shows the position of the signal peptide in each of the polypeptides and the maximum score and mean score associated with that signal peptide.

TABLE 1

| TISSUE ORIGIN | LIBRARY/ RNA SOURCE | HYSEQ LIBRARY NAME | SEQ ID NOS: |
| --- | --- | --- | --- |
| adult brain | GIBCO | AB3001 | 16–17 19 40 66 92–94 97 124 131 134 163 186 188 208 213 231 268–270 284 288 295 297 299 311 315–325 340 373 387 396 407 429 469 489 495 498–499 533 542 545 562 568 587 589 618–619 643 664 687–688 694– 695 730 748 836 876 882 884 902 925–926 948 |
| adult brain | GIBCO | ABD003 | 2 22–24 29 33 43 45 50–51 66 71 75 77 82 87–88 91–92 95 131 140 157 179 188–192 200 208 213 220 225 247 252 257 261 263–265 277 284 288 295 299 301 315–325 355–356 373 387–389 392 395–396 407 423 431 443– 444 450–451 457 459 468 476 489 495 499– 500 514 520–522 532–533 541–542 545–546 557–558 562 564 576–577 581–583 588–589 591 595 597 599 601 610 619 631–632 639 643–644 654–655 658–660 664 667 676 682 687–688 693 696 700 704 711 713–714 746 758 765–766 774–775 780 800 802 804 807 810 827 829 834 842 850 854–855 866 870– 871 878 892–893 897 899 910 916 920–921 929 931–932 934 |
| adult brain | Clontech | ABR001 | 12 51 87 142 169 178 180 245 263 286 288 290 295 304 308 311–313 375 379–380 403 425 428 431 458 486 499 503 512 557–558 567–568 606 610 641 651 695 704 730 741 754 766 810 822 827 841 850 864 871 884 897 917 920 925–927 934 946 |
| adult brain | Clontech | ABR006 | 2 14–15 22–23 29 32–33 49 66–68 83 99 111– 112 115 129 131 142 147 153 157 163 169 189–192 200 205 207 212–214 218 221 229 234 256–257 263 272 276 279 282 292–299 301 311 315 340–343 349 376–377 383–386 388 403 405 407 410 425 438 453–454 460 463 469 474 489 495 499–500 511 522 531– 532 539 541 545–546 551 556 563 565 571 579–583 591 594 606 626 628 631–632 643 647 651 678 684 691–692 700 717 721 726 730 732 741 744 754 757 769 772 774 782 788 793 810 820 827–828 853 867 869 875 879 897 913 921–922 925–926 933–934 939– 941 947 |
| adult brain | Clontech | ABR008 | 1–2 9–10 13 16–18 23 27–28 30–32 37 39 42– 43 46 49–51 66 70 76 80 83 86–87 95–97 109 111–112 116–117 124 130–131 133–134 136– 137 141–142 146–147 152–157 160 162 169 171 179 184 189–192 195 200–201 206 211– 212 216–218 239 247–248 250 252 254–258 261–263 271–272 276 278 282 288 293–295 297 300 302 307 309 311 314–326 328 333 337–341 343 347 349 351–354 358 360–361 367 374 376–378 381 384 388–390 393 395– 396 400–403 405 407 409 411 414 418–420 422 427–429 433 438 440–441 445–447 450 453–455 458 460–461 463 466–470 474 476 486 491–493 496 498–500 507 511 514 520– 521 525 527–529 531–532 534–535 542 546 |

TABLE 1-continued

| TISSUE ORIGIN | LIBRARY/ RNA SOURCE | HYSEQ LIBRARY NAME | SEQ ID NOS: |
|---|---|---|---|
| | | | 548–549 551–552 557–558 560 562 564–566 568 571–572 578–583 586–587 590–591 594 599 602 606 618–619 621 626 629 631–634 643–644 647 651 656–660 664 670 672 677 680 684 687–688 691–695 697 706 709–710 712–714 716–718 721–722 724–725 727–728 730 733 740–741 745 751–752 754 761 765 774 777–779 787 790 792–793 799 801–804 808 810 812 820 822 824 827 831–832 834 836 845 850 858–861 868–869 871–672 875– 876 883 887 891 897 900 904 907 910 913 917–920 925–927 929 931–934 938–941 946– 947 |
| adult brain | Clontech | ABR011 | 51 133 810 892 |
| adult brain | BioChain | ABR012 | 140 208 311 748 810 |
| adult brain | Invitrogen | ABR013 | 51 245 311 316–325 436 717 810 936 |
| adult brain | Invitrogen | ABR014 | 2 51 65 84 86 134 311 316–325 384 422 445 460 503 525 564 634 651 721 794 804 810 922 |
| adult brain | Invitrogen | ABR015 | 37 134 263 272 277 294 311 443 467 500 514 582–583 619 651 694 850 871–872 883 888 936 |
| adult brain | Invitrogen | ABR016 | 19 22 57 134 188 233 271 277 299 373 440 444 459 469 514 640 717 882 890 920 |
| adult brain | Invitrogen | ABT004 | 1–2 18 28 51 55–57 67 87–88 115 119 137– 139 142 163 200 204 213 218 257 263 271 282 288 299 301 311 341 358 370 378 402 407 422–423 427 458 460 463 499 504 534– 535 551 557–558 571 586 605–606 610 618 627–628 640 643 680 687 691–692 697 701– 702 715 719–721 725 727 753–754 758 771 782 810 827 859 871–872 881 913 920 925– 926 938–941 944 946 |
| cultured preadipocytes | Stratagene | ADP001 | 2 43 51 73 76 88 97 142 166 181 186 188 208 257 262–263 267–270 282 311 316–325 383 386 427–429 459 463 465 493 507 514 522 545 552 572 643 651 667 700 721 740 754 758 778 795 872 881 883 888 947 |
| adrenal gland | Clontech | ADR002 | 3–6 10–11 13 16 20–21 24 27–28 33 38 48–49 51 53–54 58 66–67 75 88 97 99 124–125 130 140 157–158 179 188 197–198 200 212–214 216 218 224 229 231 237 257 267 279 281– 282 288 302 311 326 362 376–377 381 383 396 398–403 429 443 453–454 456 459–460 474 489 515 526 531–532 540 545 550 559 564 568 577 581 586 589 599 605 610 613 631–632 643 648 651 667 670 672 681 684 699 703 706 708 717–718 734 736 751 779 785–786 795 813 817 837 871 876 887–888 897 904 907 916 921 924–926 948 |
| adult heart | GIBCO | AHR001 | 1–2 5–6 14–18 20–21 23 28 32 37 41 45 51 53 55–56 62 66 69–70 80–81 85 87 91 97 107 120–121 124 134 140–141 156 163 165–166 172 188–192 195 197–198 200 208 213 216 221 229 231 235 261–265 267 271 276 284 288 302 305 308 311 316–325 328 333–334 337–338 347 368–369 373 376–377 379–380 389 396 420 440 445 453–454 459–460 465 468 478 483–484 489 491–493 495 501 504 507 514 524 529 533 539 541–543 545 549 552–553 564 566 568 574 577 581–583 587 589–591 596 599 602 605 608–609 618–619 623 625 629–632 643 645 647 651 664 672 676 678 683–684 707 714 716–717 732 735 740 743–744 751 754 757 765 775 778 784– 786 788 807–808 810 826 828–829 842 850 860 876 878–880 890 894 897 899 902 916 923–927 933 939–941 |
| adult kidney | GIBCO | AKD001 | 1–2 5–6 13 16–17 19–23 26 28 33 38–39 43 45 48–51 55–57 60 66–67 69–73 79 82–83 87 90 94 96–97 100 103 126 131 134 140 148– 149 157 163 166 179 184 186 188–192 200– 203 213–216 220–221 224 226–229 232 235 245 252 257 261–263 268–270 272–274 276– 277 279 282 288 290 294 299 308 311 316– |

TABLE 1-continued

| TISSUE ORIGIN | LIBRARY/ RNA SOURCE | HYSEQ LIBRARY NAME | SEQ ID NOS: |
|---|---|---|---|
| | | | 325 332 335 339–340 358 360–363 373 375 379–380 386 388–389 392 395–396 402 413 421 423–424 428–429 431 436 440 444 450 454 457 459–460 468–469 476 489 492–493 499 504 511 513–514 520–521 524–526 531 533 538–542 544–547 552 564 567–568 574 577–578 582–583 590–591 595–596 598 602 607 610 613 618–619 622 631–632 639–642 644 647 651 654–655 658–659 664 667–669 673 678 680–682 684 687 689 693 696 706–707 712 714–715 717–718 721 729–731 734–736 740 744 748 754 760 771 774 782 784 789 795 807 809–810 819 825 834 836–837 842 850 859 870 872 876 878–879 884 887 890 895 897–899 902 905 910 919–921 925–926 933 936 944 |
| adult kidney | Invitrogen | AKT002 | 1 14–15 28 30 35–37 53–54 73 88 112 114 129 134 137 140 149 157 166 172 186–188 191–192 203–204 213 235 245 257 262–263 266 268–270 273–274 288–289 297 299 302 310–313 315–325 335 340 358 373 378–381 395 413 423 441 450 453 456 459–460 470 477 491–494 500 513 540 542 545 554 556 564 567 587 591 619 622 627 633 643 668–669 677 684 689 693 701–702 704 714 729–730 754 758 760 777 781 785–786 788–789 807 836–837 840 849–850 872 876 881 890 895 905–906 913 923 925–926 931–933 944 |
| adult lung | GIBCO | ALG001 | 5–6 16 28 38 51 74 97 122 124 134 140 163 188–192 200 218 221 262–263 268–272 294 311 316–325 379–380 429 463 468 493 511 520–522 537–538 542 545 568–569 595 622 643–644 664 667 711 714 721 730 754 775 850 860 863 879 887 897 925–926 944 |
| lymph node | Clontech | ALN001 | 43 98 131 140 163 188 221 245 277 299 311 491 515 546 564 593 603 610 615 630 682 694 707 717 800 831 850 878 880 936 939–941 947 |
| young liver | GIBCO | ALV001 | 3–4 17 20–21 32 43 55–56 70 100 134 137 163 172 174 179 186 188–192 200 213 216 219 221 229 232 252 275 301 311 315–325 378 381 392 441 459–460 497 499–500 514 524 526 533 539 550 568 571 588–589 595 619 622 631–632 642 658–659 664 677 680 693 700 707 713 719 743 754 757–758 766 807 834 863 867 876 884 887 904 907 |
| adult liver | Invitrogen | ALV002 | 5–6 28 35–36 52 54 70 72 86–87 103 112 127 134 140 159 179 188 200–201 213 218–219 225 239–240 257 263 271 275 311 315 367 373 388 392 444 459–460 464 468 497–499 512 527 532 542 545 562 599 605 629 640 657 680 684 687–688 706 713 715 717–718 721 742 754 758 771 791–793 818 829 843 854–855 871 878–879 887 921 933–934 |
| adult liver | Clontech | ALV003 | 159 179 189–192 201 219 257 349 392 568 664 753 796 887 934 |
| adult ovary | Invitrogen | AOV001 | 2–7 10 13 18–22 25 27–28 30–31 33 38–39 41–43 45 48 50–51 53–56 62 66–67 69 72 74–75 80 83 85–87 93 95 99–101 107 112–115 120 124–126 129 131 134–137 140 142–143 147–148 162–163 172 178 188 191–192 200 204 208 212–213 220–221 225 229 231 235 237 246–247 252–253 258 261–262 264–265 267–272 276–279 282 287–288 290 293–294 299 307–308 311 316–327 332 337–338 340–342 349 360–362 373–374 379–381 386 388–389 393 396 399 403 413–414 423 425 427 429 431 441 444–445 450 452 454–455 457 459–460 462 467–470 475 477 483–484 489 491–493 495–496 500 504–505 507 515 518–519 522–523 527–529 531 533 537–540 542 545–546 548 551–552 555 564 568 570–571 577 579 581–583 589–596 599–600 605 610 613 615–616 619 623 625–627 630–636 639 641–644 647 649 651 654–655 664 668–669 |

TABLE 1-continued

| TISSUE ORIGIN | LIBRARY/ RNA SOURCE | HYSEQ LIBRARY NAME | SEQ ID NOS: |
|---|---|---|---|
| | | | 672 676 678 680–682 684 687 694 701–704 706–707 715–717 721–722 727 729 731–732 734–735 738 740 743 748–749 753–754 758 764 771 775 777–782 784 800 802 807 821– 822 824 828 834 836–837 842 846–847 850 860–863 866 870–871 876–880 882 884 887 890–891 897 899 901 906 910 913 920–921 923–924 933 939–941 944 947 |
| adult placenta | Clontech | APL001 | 34 68 102 263 444 493 520–521 534–535 689 706 754 797–798 |
| placenta | Invitrogen | APL002 | 2 14–15 43 55–56 66–67 134 184 213 221 229 252 257 263 277 287 394 443 529 532 618 622 684 742 754 810 829 883 902 |
| adult spleen | GIBCO | ASP001 | 2 14–15 20–22 29 38 43 48 51 53–56 65 67 72 74 84 87 131–132 134 137 140 172 188– 192 200 212 221 256 263 271 282 308 311 316–325 343 383 389 423 436 441 443 459– 460 467 469 495 499–500 505 514 520–522 524 529 537 539 545 552 585 619 631–632 639 643 664 673 707 723 735 742–744 758 771 799 810 817 836 850 878 925–926 934 936 |
| testis | GIBCO | ATS001 | 1 3–4 14–16 28 31 45–46 66 85 90 95 97 103 112 128–130 134 140 163 166 188 191–192 199–200 213 226–228 261–265 267–271 284 302 311 316–325 327 379–380 391 413 421 428 444 454 457 459–460 467 491 493 495 500 505 519 525 529 532 534–535 545 552 556 566 568 575 596 599 613 616–617 647 649 651 680 684 703 707 716 719 721 727 734 738 740 744 748 758 765–766 774 777 782 802 810 817 827–828 834 842 846–847 850 862–863 871–872 878 880 892 901 916– 917 921 |
| adult bladder | Invitrogen | BLD001 | 5–6 8 20–21 28 72 91 122 126 130 166 188 197 200 213–214 225 257 262 315–325 341 409 486 491 572 593 622 650 673 691–692 810 813 861 870 877 883 887 904 |
| bone marrow | Clontech | BMD001 | 8 13–16 28 38 43 45–48 50–51 57 62–63 65 67 84–85 97 100 104 118 122–124 131 134 140 163 188 214 216 221 224 231 245 252 261–263 268–270 273–274 279 288 290 311 373 378 389–391 395 414 428 431 436 440– 441 443 451 455 459–460 465 469–470 475 495 497–498 502 507 514–519 529 537–538 542 546 550 552 556 560–561 563–564 568 576–577 580 587 589 596 601–602 610–613 619–620 626 642–643 647 651 664 666 668 676 678 681–682 684 696 704 706–707 715 727 730 732–735 740 748 753 758 761 764 771 775 780 794 800–801 830 834 836 842 850 863 871–872 878–879 882 884 888 897 900–901 904 910 921 923 929 934 947 |
| bone marrow | Clontech | BMD002 | 1–2 5–6 10 13 16–21 27 31 38 42–43 46 57 65–66 76 80 84 87 97 99 110 112 118 131 134 137 140 145 161 163 165 172 195 206 208 221 229 231 237 244 247 252 256 267– 270 272 276 278–279 282 284 288 294 301 304 307 311 316–327 333–334 337–338 345– 347 352 360–361 368 373 376–378 381 383 388 414 436 441 443 450 452 454–455 457 469–470 483–484 486 490 498 516 519–521 524 530–531 539 542–543 545–546 551 553 555 559 564 571 576–577 580 585 591 594 602 604–605 607–608 610–612 619–621 625– 626 629 631–632 639–640 644 650–651 664– 665 684 687–688 693 699 703 714 723–724 727 733 735 740 742 745 748 750–752 754– 755 777–780 784 787 794–795 802 809 817 824 827 831–832 834 846–847 850–851 854– 855 861 867 875 878 883 886 891 894 897 900 902 910 914 919 921 925–926 929 936 939–941 944 |

TABLE 1-continued

| TISSUE ORIGIN | LIBRARY/ RNA SOURCE | HYSEQ LIBRARY NAME | SEQ ID NOS: |
|---|---|---|---|
| bone marrow | Clontech | BMD004 | 65 |
| bone marrow | Clontech | BMD007 | 65 76 84 245 516 |
| adult colon | Invitrogen | CLN001 | 19–21 53 55–57 72 88 133–134 168 213 245 252 311–313 316–325 340 443 459 469 483–484 486 497 515–516 597 606 622 643 667 676 706 718 742–743 753 766 829 833 872 887 902 923 929 |
| Mixture of 16 tissues-mRNAs* | Various Vendors* | CTL016 | 52 137 189–192 316–325 529 591 |
| Mixture of 16 tissues-mRNAs* | Various Vendors* | CTL021 | 65 84 169 189–192 311 316–325 406 676 727 782 850 |
| Mixture of 16 tissues-mRNAs* | Various Vendors* | CTL028 | 65 |
| adult cervix | BioChain | CVX001 | 3–4 14–16 20–23 25 33 42–43 45 48–50 54 57 67 69 75 85 87 91 95–97 107 110 114 124 126–127 131 134 137 140 150 157 163 165 172 185–188 200 204 212–213 216 225 229 245 252 257 261–263 266–270 276 282 288 290 301–302 308 316–325 327 340 363–364 372–373 378 383 388–392 394 396 409 413–414 421 428–429 438–440 443–444 454 456–457 459 463 467 475 486 489 493 495 507 514–515 522 534–537 556 568 572 574 577 582–583 587 594 600 608 610 613 622 626 633 639 643 647–648 651 653 667 680 683 685–686 693 696 703–704 706 711 721 723–725 727 730–731 734–735 742–743 748 754–757 762 771 776 785–786 788 794 800 802 807 809–810 817 827 829 834–835 842 850 857 860 862–863 868 870 873 876–877 879–880 884 887 891 897 904–905 910 916–917 921 925–926 933 937 947 |
| diaphragm | BioChain | DIA002 | 305 311 |
| endothelial cells | Stratagene | EDT001 | 1–2 7–8 14–16 19–22 24 28–29 32–33 41 43 45 51 57 61 74 83 87–88 97 105 112 116–117 131 134 137 140 148 165 172 179 188–192 197–198 208 212–213 220–221 225 229 231 237 246 252 256–258 261–265 268–272 276–277 279 281–282 284 286 288 294 297 299 302 307–308 311–313 326 334–335 340 355–356 358 360–361 364 375 383 386 389 392 403 413 423–424 429 440 443 445 451 453 455–456 459–460 462–463 465–466 468–470 475 491 495 497–499 504 514 520–522 524–526 528 532–536 539–540 546 551–552 554 556 564 566–567 571 574–577 581–583 587 591–593 597–599 601 607 615 618 622 625 633 639 641–644 651 667 677 680 684 691–692 701–702 704 716–717 720–721 726 732–733 735 743–744 754 758 765 785–786 795 802 806 809 819 826 828–830 832 834 836 846–847 850 867 871 877–878 890–891 897 902 907 921 923 925–926 944 946 |
| esophagus | BioChain | ESO002 | 188 |
| fetal brain | Clontech | FBR001 | 33 49 51 126 134 197–198 264–265 360–361 413 460 647 810 819 871 |
| fetal brain | Clontech | FBR004 | 137 156 205 282 284 405 424 480 489 701–702 820 921 |
| fetal brain | Clontech | FBR006 | 2 9–10 18–19 22 28 30–32 37 39–40 42–43 46–47 49 57 66–67 76 80 83 96 109 112 116–117 120 124 131 133–134 136 142–143 146 152 155 160 162 165 169 173 184 189–198 200–201 205 215–216 238 244 248 254–255 257–258 260–263 272–274 276–277 282 288 293–294 307 309 311 314–328 343 347 351–352 354 357–358 360–361 373–375 378–381 390 392 400–401 403 405 407 410–411 413 420 424 429 445 450 452–453 458 460 463 467–469 472 474 477 479 483–484 491 499 507 520–521 525 527 529 531 533 538 545 551 562 564 566 571 574 579 581–583 587 591 599–600 604 606 611 626 629 631–632 638 643 651 654–655 657–660 672–673 676– |

TABLE 1-continued

| TISSUE ORIGIN | LIBRARY/ RNA SOURCE | HYSEQ LIBRARY NAME | SEQ ID NOS: |
|---|---|---|---|
| | | | 677 684 689 693–694 697 699 709 714–715 717 720–721 732–733 735 744 748 751–752 754 761 763 767 772 775 777–779 781 785–786 790 792 802 804 808 810 820 824 826 838–840 850 858–860 864 866 872–873 881 891–892 901–902 904 910–911 913 917–918 920 925–926 933 939–941 946–947 |
| fetal brain | Clontech | FBRs03 | 316–325 684 |
| fetal brain | Invitrogen | FBT002 | 2–4 20–21 45 51 53 57 88 93 125–126 134 166 184 186 188 200 213 224 263 276–278 307 311 341 373 375 418–419 423 427 432 450 452 459–460 470 492 498–499 507 514 522 534–535 545 550–552 571 577 610 714 721 743 754 795 827 861 866 872–873 887 896 925–926 934 939–941 946 948 |
| fetal heart | Invitrogen | FHR001 | 2–4 10 13 16–18 29 31–32 37–38 43 46 49 51 53 55–56 67–68 75 80 85 87 97 115 120 137 152 156 160–161 163 168–169 174 178 189–192 196 200 216 220 225 252 262 276–277 282 288 301–302 305 311 315–325 333 343 351 357–358 360–361 368–372 378 424 436 440–441 445 453 460 469 478 483–484 495 520–521 527 533 538 541–543 546 556 564–566 568 576 581 587 594–595 601–602 606 609 612 615 633 638 640 643 653–655 664–665 672–673 677 684 691–693 697 704 707 709 717 735 738 744 746 748–749 751–752 754 761 777 779 781–782 785–786 797–798 820 824 826 829 834 838 841–847 850 875 877–878 893–894 897 901 910 913 925–927 936 946 |
| fetal kidney | Clontech | FKD001 | 8 14–15 32 43 50 68 96 106 126 131 134 140 186 188 226–228 233 279 282 311 339 428 440 450 456 468 552 618 651 700 726 735 748 751 781 794 797–798 826 878 887 899 |
| fetal kidney | Clontech | FKD002 | 50 83 96 131 134 143 163 172 193–194 201 203 215 263 273–274 311 316–325 339 360–363 374 376–377 379–380 388 394 400–401 403 407 425 440 451 454 493 525 536–538 540–542 572 580 582–583 587 605–606 621 631–632 647 673 689 706 709 714 726 735 761 774 777 799 809 845–848 858 872 875 878–879 882 895 918 927 |
| fetal kidney | Invitrogen | FKD007 | 66 214 |
| fetal lung | Clontech | FLG001 | 65 179 213 223 340 360–361 491 564 577 591 627 646 650 712 715 744 758 939–941 |
| fetal lung | Invitrogen | FLG003 | 49 54 75 97 137 148 152 188 197–199 213–214 225 240 256 288 316–325 369 378 392 423 429 464 496 526 580–581 586 591 693 706 726–727 766 878 913 925–926 939–941 |
| fetal lung | Clontech | FLG004 | 388 921 |
| fetal liver-spleen | Columbia University | FLS001 | 1–23 25–39 41–43 45–46 49–65 76 83–84 87–88 91 94 97 100 112 118 122 126 129–130 134 137 140 148 163 168 172 179 186 188–189 191–192 197–198 200–201 213–214 216 221 225–229 231–232 235 242 252–253 256–258 262–271 277 284 287–288 297 299 307–309 311 315–326 330 355–356 360–362 370 373 378–380 388 392 394 396 400–402 413 426 428 436 440–441 443–447 450 454–455 457 459–460 463–465 467–469 475 477–478 489–509 511–514 519–521 525–527 529–535 537 539 542 545 551–552 555–556 559 561 567 569 571 576–577 580–583 586–587 589 591–592 595 598–602 605 607 610 612–613 618–619 623 625–626 631–632 638–640 642–644 646–647 649 651–652 654–655 667 673 676 680–681 683–684 700 703–704 706 711 715–718 720–721 726 732–735 740 742–744 748 754 756–758 763–765 771 774–775 777–782 785–786 790 793–795 797–798 806–808 815 818 824–826 829–830 834–835 837 841 846–847 849–850 856 860–861 866 870–872 876 878 881–883 888 894 897–898 902 905 907 910 919 924–926 929 933 942 947 |

TABLE 1-continued

| TISSUE ORIGIN | LIBRARY/ RNA SOURCE | HYSEQ LIBRARY NAME | SEQ ID NOS: |
|---|---|---|---|
| fetal liver-spleen | Columbia University | FLS002 | 1 3–4 11–12 14–17 20–23 26–29 32–34 38 41 43 45–47 49 51–52 55–62 65–67 76 83–85 87–88 90–91 95 97–99 104–105 112 114–117 126 130 133 150 163 165 172 178 186–187 193–194 200–202 208 213 221 225 229 232–235 244–246 248–253 256–257 262–265 267–271 273–274 284 287 299 311 315 326 335 337–338 343 355–356 358 375–378 381 392 394 400–402 414 416 426 428–429 440–442 444–447 453–455 457 459 461 464–465 467 476–477 483–484 489–490 492 495 497–500 504 506–507 509 511–514 519 522 524 526 532–535 537 539–540 542 545 551–552 556 567 569 574 576–577 581 589–590 592 599 601–602 605 607 610 612–613 619–620 625 627 629 631–632 638 640–641 646 648–649 654–655 667 670 683–684 687–688 693 696 700 703–706 713 716–721 726 734–735 740 742 744 748 754 758 771 775 777–778 780–782 785–787 790–792 794–799 801–802 806 808 818 824 829 835 849–850 852–855 857 870–871 876 882–884 886 888 890 894 897–898 900 902–903 907 919 921 923–926 929–930 933 938–942 |
| fetal liver-spleen | Columbia University | FLS003 | 30 34 67 85 88 89 130 172 188–189 191–192 213 229 231 257 311 315–325 329 331 335 362 391 394 400–402 423 441 455 457 461 476 498 500 511 523 531–532 537 542 576 587 592 612–613 625 649 665–666 703 719 731 733 740 744 771 775 777–778 787 797–798 819 824 826 850 854–856 861 863 870 879 884 897 923 931–933 947 |
| fetal liver | Invitrogen | FLV001 | 2 7 19 28 35–37 47 52 54–56 66 95 134 139 179 188–192 200 213 218 263 272 288 294 305 311 315 349 378–381 388 392 403 426 443 454 459–460 469 496–499 514 527 529 532 534–535 555 586 605 640 644 658–659 673 680 687 698 713 715 720–721 723 726 754 758 778 795 817–818 829 853 861 868 870–871 897 903 933 |
| fetal liver | Clontech | FLV002 | 52 189–192 219 297 308 335 364 378 427 828 |
| fetal liver | Clontech | FLV004 | 2 19 28–29 37 39 49 52–53 55–56 62 65–66 76 87 124 134 137 139 142 179 188 195 208 216 219 244 252 263 268–270 272 277 287–288 294 303 305 311 315–325 339 355–356 358 360–361 368 374 378 403 441 454–455 460 477 483–484 497 514 520–521 542 553 582–583 587 591 594 611–613 620–621 638–639 654–655 658–659 681 684 687–688 709 721 730 738 744 752 754 781 793 802 813 818 826 832 836 854–855 876 878 893 897 900 910 924 933 944 |
| fetal muscle | Invitrogen | FMS001 | 28 65 115 121 126 134 137 156 168 172–173 181 213–214 225 263 267 305 340–341 360–361 440 459 516 534–535 543 564 586 606 609–610 623 650 676 683 754 766 853 871 886 894 930 934–935 948 |
| fetal muscle | Invitrogen | FMS002 | 19–21 41 49 51 53 57 75 96 101 103 112 134 136 156 171 184 188 191–192 212 216 250 262 267 276 305 311 342 348–350 355–356 360–361 374 392 403 411 415 423 425 457 469 491 495 499 508 515 517 534–536 543 546 564 566 576 580 582–583 587 594 599 609 611 615 618 623 644 647 658–659 664 668–669 677 683 691–692 696 703 735 743 754 766 788 802 817 826 828 850 877–879 894 910 925–926 935 |
| fetal skin | Invitrogen | FSK001 | 3–7 18 24 27 29 35–37 51 53 55–56 66–67 76 90 95 97 122 126 134 136–137 166–167 181 188–192 208 213–214 224–225 245 250 252 257 260 262 268–271 273–274 282 284 297 302 312–313 315–326 341 367 373 375 378 383 387–388 390 394 423 429 440–441 450 454–455 457 459 463–464 470 472 475 486 489 492 495 498–500 511 514 524 527 530– |

TABLE 1-continued

| TISSUE ORIGIN | LIBRARY/ RNA SOURCE | HYSEQ LIBRARY NAME | SEQ ID NOS: |
|---|---|---|---|
| | | | 532 534–535 541–542 545 550 552 555–556 565 571 586 589 591–592 602 604 606 610 613 618 622–623 626 631–632 640 651 654– 655 672–673 685–686 693 701–702 704 706 717–718 720 723 727–728 744 754 762 764– 766 768–771 795 809 814 821 824 827 843 853 868 870–874 887–888 890 897 902 907 925–926 928 930 933–934 939–941 944–945 947 |
| fetal skin | Invitrogen | FSK002 | 2 5–6 19 29 34 51 57 59 88 97 101 124 131 134 143 163 166 172 189 191–192 196 212 216 222–223 231 250 257 263 268–272 282 284 287–288 294 297 299 302 304 310–311 316–325 328 333 340 352 360–361 365–367 372 379–380 388 390 400–401 403 410–411 440 449–450 454 457 463 470 478 491 495 500 505 515 520–521 524 532 534–535 541 555 560 562 564 572 576 581 592 595 599 611 622 626 630 636 640 642 650 664 677 683 691–693 696 699 701–702 708–709 715 721 723 728 735 744 747–748 750 754 766 779 782 799 803 807 813 820 824 826 834 846–847 867–868 872–874 878–879 890–891 897 901 904 907 910 912 916 918 925–926 933 944–945 |
| fetal spleen | BioChain | FSP001 | 311 748 |
| umbilical cord | BioChain | FUC001 | 1–2 29 32 46 67 83 87 94 134 136 140 148 160 163 166 172 181 186–192 197–198 208 213 216 225–231 237 252 261–265 267–270 279 282 288 295 302 308 311 316–326 339– 340 365 376–377 379–380 384 392–397 421 423 428 433 440 445 452 459 461 463–464 470 472 489 491 495 497 500 507 517–518 522 525–526 528 534–535 540 545–546 556– 558 564 566 568 571–572 577 592 599 601 605 610 618 623 644 651 661 668–669 673 678 680 685–686 696 706 709 718 735–736 748 754 769 772–777 782 792 797–799 802 807 809 815 817 824 850 854–855 870 876 881 888 891 897 899 901 913 921 928 930– 932 |
| fetal brain | GIBCO | HFB001 | 2 12 16–17 19 23 27–28 32–33 39 41–45 49 87–89 94 97 100 107 112 130–131 134 142 157 163 172 188–192 200 216 224–225 231 237 242 246 252 258 261 263–265 271 273– 274 276–277 288 295 299 301 307 311 314– 326 328 341 355–356 373 375 387 389 392 395 424–425 431 438 445 450–452 457 459– 460 468–469 475 489 491 495 500 504 511 514 520–529 531 533 540–542 545 552 554 557–558 566 576–577 579–584 587 591 596 598–599 606 613 626 631–632 643 651 664 668 673 676 680 693–694 696 703–704 716– 717 721 727 735 738 740 744 748 757–758 769 774 778 780–781 810 827–828 830 850 869 871–872 876 878–879 884 890 892 897 899 904 906–907 913 916 918 920 924 928 934 938 946 |
| macrophage | Invitrogen | HMP001 | 49 97 208 252 301 306 311 316–325 337–338 345–346 416 512 522 572 670 716 743 785– 786 802 888 919 923 |
| infant brain | Columbia University | IB2002 | 2–4 12 14–15 20–21 23–24 27 29 31–32 39 41 46 48–49 51 53 55–56 66 75–76 86–88 93 95 101 105 108–109 116–117 125 127 129 131 136 145 163 166 170 180–181 186 188–189 191–192 200–201 207–208 212–214 216 220 224 229 231 245 247 252 257 259 264–265 267 271 279 282 288 293 295 299–300 311 314–326 337–338 340 349 367 373 375 388 390–393 396 402 405 407 418–421 424 428– 429 431 433 436 450 452–453 457 459 463 468 489 495 496–500 507 511 522–524 526 528–530 532 541–542 545–546 552 557–558 562 564–566 571 577–583 587 589–591 599– 601 606 608 613–614 619 631–632 647 654– |

TABLE 1-continued

| TISSUE ORIGIN | LIBRARY/ RNA SOURCE | HYSEQ LIBRARY NAME | SEQ ID NOS: |
|---|---|---|---|
| | | | 655 658–659 667 676 684 691–693 696 700 704 711 718 721 723 725 740–741 743–744 748 754 775 777–778 780 788 792–793 795 802 805 808 819 826–829 834 836 838 861 863 869–870 875 879 881–882 884 887 890–891 893 897 902 920–921 925–926 934 938–941 946 |
| infant brain | Columbia University | IB2003 | 2 27 37 39 43 48–49 51 53 85–87 97 106 113 124 126–127 131 142 166 170 188 200–201 208 214–215 220 224 226–228 231 251 257 263 267 271–272 279 288 293 299 311 314–326 337–339 349 360–361 367 386 392 397 400–402 407 410 418–419 424–425 427 429 452 454 460 475 489 495 497–500 507 522–523 525 529 532 539 542 545–546 551–552 557–558 564–565 578 582–583 585 591 601 606 625–626 631–633 643–644 673 690–693 701–702 706 711 721 723 734 740–741 743–744 748 751 754 761 778 788 795 802 808 819 826–827 829 837 843 869–871 875 878–880 884 896–897 902 920 933–934 946 |
| infant brain | Columbia University | IBM002 | 32 43 66 340 387 541 562 693 712 751 795 829 871 920 925–927 929 |
| infant brain | Columbia University | IBS001 | 2 29 37 39 76 142 163 392 455 495 499 606 681 741 754 778 |
| lung, fibroblast | Stratagene | LFB001 | 2–4 22 28 32–33 47 51 79 120 129 134 140 163 172 188 208 220–221 231 252 257 263 276–277 284 307 375 378–380 396 423 428 440 450 459 463 486 491 493 495 499 539 571 591 601 607 613 615 618 625 639 651 684 716–717 721 727 735 748 782 828 850 870–871 |
| lung tumor | Invitrogen | LGT002 | 2 5–8 13 16–17 29–31 35–39 43 46 57 67 72 76 78 81 85 87 90 94 97 100 110 119 122 130–131 134 137 140 146 149 167 172 174 179 188 197–198 201 213 216 218 220–221 223 231 245–246 251–252 256–257 262–263 267–270 277 284 288 296 299 301–302 311 316–325 340 354 373 379–380 388 392 395 400–401 410 413 421 431 436 441–443 445 451 455 457 460 463–464 467 469 475 478 489 491 493 497 499 504 507 514 518–519 524 529 534–535 537 542 545–546 548 552 555 559 568 578 581–583 592 597 602–603 605–607 613 615 619 621–622 636–637 642–643 646–647 654–655 679–681 684 687–689 693 701–702 704 706 711 713 715–716 718 727 732–734 738 748 753–754 757–758 760 762 766 769 774 782 785–786 802 817 829 834 850 853 859–860 866–867 870–871 878–879 887 890 899 902 904 910 917 923 925–926 936–937 |
| lymphocytes | ATCC | LPC001 | 2 16 19–21 25 31–32 49 53 55–56 63 67 85–87 90 97 120 122 137 140 163 165 168 172 188 197–198 215–216 221 229 231 236–238 248 252 256 272–274 283–284 288 294 299 316–326 343 368 374 378 395 423 431 454–455 467 469 476 478 491 495 498 505 512 515 517–518 520–522 524 526 529 531–532 537 539 542 545–546 551 556 571 577 580 589–590 592 596 601 622 631–632 640 642 654–655 664 666 668–669 673 684 703 708 716 718 721 723 727 733 735 743–744 754 758 765 771 775 777–779 783–786 797–799 810 816–817 828 834 845 859 861 863 870 878–879 881 884 887 890 897 904 907 910 912–913 918 923 929 939–942 945–947 |
| leukocyte | GIBCO | LUC001 | 2–4 7–8 13–17 20–23 31–33 38 43 48–49 51 53–57 63 66–68 74–78 85–88 93 97 122 124 129 131–132 134 137 140 163 166 168 171–172 175 188–192 197 200 208–213 216 221 223 231 236 242 252 257–258 261–263 268–270 272 277 279 287–288 294 307 311 314 316–326 329 337–339 341 373–374 376–377 381 388–392 396 400–401 413–414 423 436 |

TABLE 1-continued

| TISSUE ORIGIN | LIBRARY/ RNA SOURCE | HYSEQ LIBRARY NAME | SEQ ID NOS: |
|---|---|---|---|
| | | | 441 450 454–455 459 463 465 467 489 491–493 495 498–499 504–505 507 514 518 520–522 524 526 529 531 533 536–537 539–540 545 552–554 556 568 571 577 580 585 589–590 596 599 602 605 607 610 612–613 615 618–619 621–622 625 638 640 642–644 664 667 677–678 684 690–693 696 700 703–704 707 713 715–718 721 727 734–735 738 740–746 748 753–754 758 775 778 780 789 794 797–798 801–802 815 817 825 827 829 834 836 846–847 850 859–861 863–864 866–867 871–872 878 884 886–888 891 896–897 902 904 910 913 916 921 923–926 929–932 936 943 |
| leukocyte | Clontech | LUC003 | 12 14–15 18 32 111 134 137 172 221 277 280 311 316–325 436 454 467 549 552 568 585 603 643 691–692 698–699 734 744 751 754 784 797–798 861 897 916 923 |
| Melanoma from cell line ATCC CRL #1424 | Clontech | MEL004 | 3–4 16 20–21 43 46 48 97 103 147 163 188 191 213 216 221 231 241 245–246 260 262–263 316–325 381 407 431 504 525 527 542 556 568 577 589 596 607 613 676 693 714 735 737–739 744 758–760 775 822 850 863 878 887 897 |
| mammary gland | Invitrogen | MMG001 | 1–8 14–18 20–21 25 28–29 37 39 43 49 51–57 60 66–67 72 75–76 87 95 97 103–104 106 112 115 119 122 127 130 134 137 139 142 150 166–168 172 175 184 186 188–189 191–192 200 213–214 222–224 226–229 240 252 257–259 263 267 271 276 278 282 287–288 299 301–302 305 307–308 311–313 316–325 327–328 332 340–341 358 360–362 369 373 378 381 383 388 390–392 397 402–403 409 415–416 423 425 428–429 433 436 444 454–456 459–460 464 467 469 481 483–484 486 493 495 498–499 515 524–525 529–530 532–537 541–542 545 551–552 562 582–583 586–587 593 599–600 602 604–605 610 618–619 622 625–627 634 644 646–647 652 654–655 662 673 676 680 684 687–688 691–692 701–703 715 717 721 723 726 735 743 751 754 758 765–766 771 777–778 789 803 805 807 809–811 821 827 829 850 860 887–888 892 896 898 901–902 905 911 913 917 925–926 930 936 939–942 |
| induced neuron cells | Stratagene | NTD001 | 2 16 32 51 66 88 97 124 130 134 137 172 188–189 191–192 231 252 257 260 277 291 373 424 431 454 460 489 495 523 525 582–583 591 631–632 643 649 670 695 725–726 735 765 789 797–798 837 850 878 884 888 890 913 929 946 |
| retinoid acid induced neuronal cells | Stratagene | NTR001 | 2 5–6 20–22 136–137 188–194 197–198 224 311 375 381 410 457 462 475 495 531 546 548 552 599 618 678 743 752 819 828 890 895 897 930 934 938 944 946 |
| neuronal cells | Stratagene | NTU001 | 2 5–6 20–21 55–56 87 137 188–192 197–198 215–216 260 287 291 310–311 316–325 365 375 423 457 459 470 499 532 542 564 576 598–599 623 643 651–652 673 721 726 743 745 752 754 765 780 787 789 822 829 870 875 888 896 917 919 929 |
| pituitary gland | Clontech | PIT004 | 41–42 83 85 97 134 193–194 204 208 213 224 257–258 263–265 285–286 308 311 360–361 413 443 445 491 514 529 532 639 644 647 682 701–702 716 781 822 829 836 850 933 939–941 947 |
| placenta | Clontech | PLA003 | 16 31 34 49 66 80 87 97 101–102 134 158 165 172 179 184 188 197–198 209–210 218 220 229 235 249 256 267–270 277 287–288 302 307 332 360–361 365 388 394 414 441 444 454 457 460 493 498–500 505–506 509 529 531–532 550 559–560 564 572 587 601 625 630–632 638 672 682–684 689 706 708 726 733 735 744 754 761 784–786 793 863 875 897 924 929 937 |

TABLE 1-continued

| TISSUE ORIGIN | LIBRARY/ RNA SOURCE | HYSEQ LIBRARY NAME | SEQ ID NOS: |
|---|---|---|---|
| prostate | Clontech | PRT001 | 7–8 51 85 87 97 100 122 134 139 214 216 221 231 257 271 276 335 337–338 392 400–401 431 440 459 477 530 534–535 546 556 582–583 599 622 631–632 639 651 663–664 673 683 707 715 735 740 765 773–774 777 810 823 897 909 919 934 939–941 947 |
| rectum | Invitrogen | REC001 | 18 54 66 134 137 169 188 200 213 225 251 263 288 311–313 316–325 340 388 423 429 441 454 459 514 532 542 610 626 646 651 657 715 719 723 728 735 740 758 766 785–786 823 829 833 836 886 942 |
| salivary gland | Clontech | SAL001 | 31 49 78 95 134 136–137 143 176 188 208 223 244 268–270 284 308 311 316–325 388–389 391 436 441 459 476 514–515 520–521 532 543 568 589 596 610 619 684 691–692 713 718 727 736 754 777 824 836 864 867 878 883 897 901–902 916–917 933 938–941 |
| salivary gland | Clontech | SALs03 | 460 |
| skin fibroblast | ATCC | SFB001 | 379–380 850 |
| skin fibroblast | ATCC | SFB002 | 742 850 |
| skin fibroblast | ATCC | SFB003 | 87 |
| small intestine | Clontech | SIN001 | 27–29 31 38 40 46 48 51 54 57–58 62 65 67 75 77 85 97 110 112 116–117 119 131–132 134 137 140 161 163 166 168 177 188 197–198 208 213 220 224 229 246 257 261–262 264–265 276–277 288 295 297 299 311 316–326 328–330 337–338 340 360–361 373 375 382 390–391 410 413 428–429 436 438 440 453–454 459 468 476–477 497 507 511 522 531 536 538 542 545–546 548 552 556 564 570–571 576 580–581 586–587 591 596 599 605 610 613 619 625–626 643–644 651–653 664–666 668–670 677 680 684 693 700–702 706–707 713–715 723–724 729–730 735 740 746 748 753–754 757–758 764 777–778 784–786 818 822 824 826–829 833–837 842 862–863 865–867 877–878 886 897 900–902 906 913 916 921 925–926 936 939–941 |
| skeletal muscle | Clontech | SKM001 | 42 98 156 163 191–192 200 261 305 311 395 415 462 468 504 531 543 566 582–583 585 594 680 740 853 875 927 933 935 |
| skeletal muscle | Clontech | SKM002 | 850 |
| spinal cord | Clontech | SPC001 | 18 23 33 37 42 51 67 87 92 94 97 100 140 162 184 188 191–192 208 213 220 231 248 262 268–271 273–274 282 287–288 290 307 311 316–325 358 364 376–377 383 387 389–390 402 412 422 444 455 476 483–484 489 504 522 534–535 556 562 587–588 591 597 603–604 618–619 643 651 667–670 677 693 703–704 717–718 727 746 757 773 808 810 827 834–835 837 850 871–872 875 904 910 931–932 939–941 |
| adult spleen | Clontech | SPLc01 | 33 38 57 67 75 87 134 142 163 216 221 229 244 257 304 307 311 316–325 340 355–356 378 441 468 525 538 545 560 564 599 721 754 766 780 794 827 841 850 866 |
| stomach | Clontech | STO001 | 18 65 88 163 188 208 213 261 272 277 286 294 336 373 396 412 459 514 553 602 610 647 651–652 671 673 714 774 790 831 833 842 850 876 |
| thalamus | Clontech | THA002 | 2 87 96 103 106 189–192 208 252 258 295 308 311 367 376–377 383–384 445 455 459–460 498 529 587 598 602 629 654–655 705–706 715 717 723 754 775 810 817 822 864 867 881 892 927 930 |
| thymus | Clontech | THM001 | 3–4 8 18 28 54 57 63 65 68 84 97 100 116–117 122 134 142 151 169 171–172 188 195 197–198 201 213 221 237 245 261 287 311 316–325 360–361 376–377 423 441 444 459 489 491–493 495 498 504 507 514 527 532 534–536 539 553 556 568 571–572 590 595–596 599 610 618 622 631–632 643 647 651 654–655 664 687–688 691–693 703 715 721 733–735 748 760 762 765 781 794 799 802 831 834 836 842 850 860–861 863 871 878 |

TABLE 1-continued

| TISSUE ORIGIN | LIBRARY/ RNA SOURCE | HYSEQ LIBRARY NAME | SEQ ID NOS: |
|---|---|---|---|
| | | | 885 896–897 903 910 923 925–926 928 939–941 |
| thymus | Clontech | THMc02 | 2–4 17 20–22 37–38 42–43 46 63 65–68 76 88 95 103 118 120 124 134 137 140–141 143 163 165 171 179 182 189–194 198 200 212–215 221 226–228 231 244 257 262 266 276–277 287–288 297 299 307 316–325 341 352 358 360–361 373 376–377 379–381 389 391 394–396 403 410–411 436 440 445 450 459 463–464 469 478 491 495 500 507 511 519–521 530 532 539 542 550 555 560 563 576 581 587 595 601 610–611 613–614 618 622 625–626 631–632 638 642–644 657 664 667 670 673 680 683 687 691–693 699 715–716 721 740 743–744 747–754 761 763–765 771 777 780–781 784–787 790 794 805 811 820 826 831 834 841 845 861 867–868 878 881 883 891 893–894 896–897 902 904 910 912–914 918 923 936–941 946–947 |
| thyroid gland | Clontech | THR001 | 1–2 18–21 27 32 38 42 46 49 51 53–56 66 72 77–78 87–88 97 115 119 124 130–131 134 136 152 163–165 172 183 188–192 202 212–213 216 221 224 229 235 241–243 252 257–258 261 263–265 267 277 279 297 301 305 308 311 316–325 327 357 363 373 376–377 381 383 389 397 400–401 410 413–414 427–428 443–444 446–447 457 459 463 467–469 475 482 489 495 499–500 504 509 513 519–522 526 529 533 537–538 542 545–546 548 556 564 567–568 582–583 589 592 599 605 608 611 621 623 630 642–644 648 651–652 654–655 664 672–676 684–686 691–694 700 706–708 713 717–718 721–722 725 729 731 734–735 740 748 753–754 760 764 766 771 774 777 781 792 797–800 802 805 826 828–829 834 842 850 861 863 868 876 879 897 899 901 910 913 929 937 939–941 |
| trachea | Clontech | TRC001 | 20–21 38 112 161 163 188 263 267 327 413 420 457 459–460 471 514 540–541 552 572 574 622 639 654–655 676–677 691–692 707 725 743 748 765 777–778 862 868 897 905 908 944 |
| uterus | Clontech | UTR001 | 51 67 126 130 133 140 188–192 229 267 329 373 440 491 514 599 685–686 693 713 716–717 735 897 905 911 939–941 |

*The 16 tissue-mRNAs and their vendor source, are as follows: 1) Normal adult brain mRNA (Invitrogen), 2) normal adult kidney mRNA (Invitrogen), 3) normal adult liver mRNA (Invitrogen), 4) normal fetal brain mRNA (Invitrogen), 5) normal fetal kidney mRNA (Invitrogen), 6) normal fetal liver mRNA (Invitrogen), 7) normal fetal skin mRNA (Invitrogen), 8) human adrenal gland mRNA (Clontech), 9) human bone marrow mRNA (Clontech), 10) human leukemia lymphablastic mRNA (Clontech), 11) human thymus mRNA (Clontech), 12) human lymph node mRNA (Clontech), 13) human spinal cord mRNA (Clontech), 14) human thyroid mRNA (Clontech), 15) human esophagus mRNA (BioChain), 16) human conceptional umbilical cord mRNA (BioChain).

TABLE 2

| SEQ ID NO: | ACCESSION NUMBER | DESCRIPTION | SMITH-WATERMAN SCORE | % IDENTITY |
|---|---|---|---|---|
| 1 | Z99162 | *Schizosaccharomyces pombe* putative transporter | 134 | 30 |
| 2 | U44839 | *Homo sapiens* UHX1 protein | 3719 | 100 |
| 3 | AF031939 | *Mus musculus* RalBP1-associated EH domain protein Reps1 | 3687 | 94 |
| 4 | AF031939 | *Mus musculus* RalBP1-associated EH domain protein Reps1 | 1887 | 57 |
| 5 | U69490 | *Mus musculus* p56lck-associated adapter protein Lad | 173 | 37 |
| 6 | U69490 | *Mus musculus* p56lck-associated adapter protein Lad | 173 | 37 |
| 7 | AL161538 | *Arabidopsis thaliana* disease resistance N like protein | 398 | 33 |
| 8 | W88660 | Secreted protein encoded by gene 127 clone HSUBW09. | 175 | 97 |
| 9 | D50617 | *Saccharomyces cerevisiae* YFL025C | 306 | 34 |
| 10 | AB028070 | *Homo sapiens* activator of S phase Kinase | 193 | 42 |
| 11 | Y27676 | Human secreted protein encoded by gene No. 110. | 474 | 100 |

TABLE 2-continued

| SEQ ID NO: | ACCESSION NUMBER | DESCRIPTION | SMITH-WATERMAN SCORE | % IDENTITY |
|---|---|---|---|---|
| 12 | Y30721 | Amino acid sequence of a human secreted protein. | 355 | 98 |
| 13 | AF257330 | Homo sapiens COBW-like protein | 566 | 97 |
| 14 | AF089812 | Mus musculus ubiquitin-conjugating enzyme HR6A | 378 | 98 |
| 15 | AF089812 | Mus musculus ubiquitin-conjugating enzyme HR6A | 688 | 90 |
| 16 | Y94959 | Human secreted protein clone mc300_1 protein sequence SEO ID NO: 124. | 204 | 97 |
| 17 | AF212247 | Homo sapiens CDA08 | 2664 | 92 |
| 18 | AF064868 | Rattus norvegicus brain-enriched guanylate kinase-associated protein 1; BEGA1 | 452 | 45 |
| 19 | W67863 | Human secreted protein encoded by gene 57 clone HFEBF41. | 551 | 98 |
| 20 | AL132954 | Arabidopsis thaliana putative protein | 201 | 25 |
| 21 | AL132954 | Arabidopsis thaliana putative protein | 361 | 34 |
| 22 | Y48359 | Human prostate cancer-associated protein 56. | 403 | 98 |
| 23 | AF202892 | Mus musculus Kif21a | 5679 | 92 |
| 24 | W75143 | Human secreted protein encoded by gene 23 clone HBMCT32. | 148 | 100 |
| 25 | Y35921 | Extended human secreted protein sequence, SEQ ID NO. 170. | 548 | 99 |
| 26 | Y27587 | Human secreted protein encoded by gene No. 21. | 448 | 100 |
| 27 | AF190900 | Homo sapiens kelch-like protein C3IP1 | 1767 | 74 |
| 28 | X12517 | Homo sapiens C protein (AA 1–159) | 903 | 99 |
| 29 | AY014403 | Homo sapiens kinesin-like protein RBKIN1 | 9290 | 99 |
| 30 | AF240783 | Mus musculus ELKL motif kinase 2 short form | 194 | 48 |
| 31 | Y02661 | Human secreted protein encoded by gene 12 clone HFTCU19. | 858 | 81 |
| 32 | AF271070 | Homo sapiens amino acid transporter system A1 | 2466 | 100 |
| 33 | W75151 | Human secreted protein encoded by gene 34 clone HTEGA81. | 507 | 100 |
| 34 | AF206329 | Mus musculus polydom protein | 3886 | 81 |
| 35 | AF162224 | Mus musculus angiopoietin-related protein 3 | 138 | 23 |
| 36 | Y35996 | Extended human secreted protein sequence, SEQ ID NO. 361. | 503 | 97 |
| 37 | AF022891 | Drosophila melanogaster Fuzzy | 248 | 30 |
| 38 | X76775 | Homo sapiens HLA-DMA | 1091 | 100 |
| 39 | Y16045 | Arabidopsis thaliana leucine-rich repeat protein | 160 | 33 |
| 40 | AC003077 | Homo sapiens 60% similar to AB002297 (PID:g2224539) | 2629 | 61 |
| 41 | W74887 | Human secreted protein encoded by gene 160 clone HCELB21. | 203 | 100 |
| 42 | AC005390 | Homo sapiens R31180_1 | 1550 | 66 |
| 43 | M98450 | Oryctolagus cuniculus casein kinase-II beta | 668 | 100 |
| 44 | Y10840 | Amino acid sequence of a human secreted protein. | 349 | 100 |
| 45 | AL050231 | Drosophila melanogaster alternatively spliced form | 203 | 46 |
| 46 | U58280 | Mus musculus second largest subunit of RNA polymerase I | 4956 | 89 |
| 47 | AJ224819 | Homo sapiens tumor suppressor | 457 | 42 |
| 48 | AF205935 | Mus musculus MGA protein | 3477 | 77 |
| 49 | AF095352 | Homo sapiens RAB-like protein 2B | 718 | 99 |
| 50 | L20321 | Homo sapiens protein serine/threonine kinase | 394 | 41 |
| 51 | Y13374 | Homo sapiens putative prenylated protein | 397 | 87 |
| 52 | AJ302031 | Rattus norvegicus putative alpha 1B-glycoprotein | 519 | 40 |
| 53 | AF145681 | Drosophila melanogaster BcDNA.LD23181 | 828 | 47 |
| 54 | AJ132192 | Mus musculus HS1 binding protein 3 | 1454 | 75 |
| 55 | AF145681 | Drosophila melanogaster BcDNA.LD23181 | 692 | 53 |
| 56 | AB036800 | Drosophila melanogaster egg-derived tyrosine phosphatase | 828 | 47 |
| 57 | Y87327 | Human signal peptide containing protein HSPP-104 SEQ ID NO: 104. | 584 | 100 |
| 58 | Y36237 | Human secreted protein encoded by gene 14. | 177 | 100 |
| 59 | Y87310 | Human signal peptide containing protein HSPP-87 SEQ ID NO: 87. | 370 | 100 |
| 60 | AF062476 | Mus musculus retinoic acid-responsive protein; STRA6 | 1437 | 74 |
| 61 | Y38394 | Human secreted protein encoded by gene No. 9. | 213 | 100 |
| 62 | AL139421 | Homo sapiens dJ717I23.1 (novel protein similar to Xenopus laevis Sojo protein) | 3267 | 100 |
| 63 | AL359782 | Trypanosoma brucei possible (hhv-6) u1102, variant a dna, complete virion genome. | 142 | 50 |
| 64 | Y19561 | Amino acid sequence of a human secreted protein. | 514 | 100 |
| 65 | L12690 | Homo sapiens neutrophil peptide-1 | 493 | 100 |
| 66 | AF274057 | Rattus norvegicus GRIP-asaociated protein 1 long form | 3814 | 92 |
| 67 | AL162458 | Homo sapiens bA465L10.2 (novel C2H2 type zinc finger protein similar to chicken FZF-1) | 6467 | 99 |
| 68 | Y87100 | Human secreted protein sequence SEQ ID NO: 139. | 267 | 100 |
| 69 | Y86320 | Human secreted protein HPRBC80, SEQ ID NO: 235. | 361 | 100 |
| 70 | Z99162 | Schizosaccharomyces pombe putative transporter | 169 | 27 |
| 71 | S67057 | Cricetulus migratorius = Armenian hamsters, Peptide, 223 aa serum amyloid P, SAP, female protein, FP = pentraxin | 158 | 71 |
| 72 | Y36183 | Human secreted protein #55. | 449 | 96 |
| 73 | U08813 | Oryctolagus cuniculus 597 aa protein related to Na/glucose cotransporters | 1231 | 85 |
| 74 | AB009883 | Nicotiana tabacum KED | 202 | 23 |
| 75 | AX015323 | Homo sapiens hFATP1 | 3367 | 99 |
| 76 | AB013361 | Homo sapiens DPM2 | 153 | 100 |
| 77 | Y25732 | Human secreted protein encoded from gene 22. | 212 | 100 |
| 78 | M37033 | Homo sapiens CD53 glycoprotein | 116 | 95 |
| 79 | Y36098 | Extended human secreted protein sequence, SEQ ID NO. 483. | 193 | 100 |
| 80 | AB021644 | Homo sapiens gonadotropin inducible transcription repressor-4 | 886 | 60 |
| 81 | U68267 | Mus musculus myosin binding protein H | 1202 | 66 |

TABLE 2-continued

| SEQ ID NO: | ACCESSION NUMBER | DESCRIPTION | SMITH-WATERMAN SCORE | % IDENTITY |
|---|---|---|---|---|
| 82 | Y36332 | Human secreted protein encoded by gene 109. | 268 | 100 |
| 83 | AF254956 | *Homo sapiens* candidate tumor suppressor protein | 2030 | 99 |
| 84 | L12690 | *Homo sapiens* neutrophil peptide-1 | 493 | 100 |
| 85 | AF295378 | *Homo sapiens* MAGEF1 | 754 | 50 |
| 86 | AF144627 | *Mus musculus* SLIT1 | 283 | 32 |
| 87 | AF208536 | *Homo sapiens* nucleotide binding protein; NBP | 1372 | 100 |
| 88 | Y59657 | Secreted protein 108-003-5-0-A8-FL. | 689 | 100 |
| 89 | Y27626 | Human secreted protein encoded by gene No. 60. | 352 | 100 |
| 90 | AF035268 | *Homo sapiens* phosphatidylserine-specific phospholipase A1 | 498 | 41 |
| 91 | Y12861 | Human 5' EST secreted protein SEQ ID NO: 451. | 448 | 100 |
| 92 | Y53049 | Human secreted protein clone cj378_3 protein sequence SEQ ID NO: 104. | 463 | 100 |
| 93 | Y41354 | Human secreted protein encoded by gene 47 clone HUFCJ30. | 288 | 100 |
| 94 | W74777 | Human secreted protein encoded by gene 48 clone HFCAI74. | 245 | 100 |
| 95 | AB040610 | *Homo sapiens* glycoprotein beta-Gal 3'-sulfotransferase | 388 | 47 |
| 96 | D32215 | *Danio rerio* emx2 homeoprotein | 1242 | 92 |
| 97 | Y94959 | Human secreted protein clone mc300_1 protein sequence SEQ ID NO: 124. | 204 | 97 |
| 98 | AF024496 | *Caenorhabditis elegans* contains similarity to *Plasmodium falciparum* glycophorin-binding protein homolog 2 (GB:X69769) | 390 | 30 |
| 99 | A09779 | *Homo sapiens* interferon-gamma receptor segment binding interferon-gamma | 600 | 99 |
| 100 | AE002030 | *Deinococcus radiodurans* thermoresistant gluconokinase | 246 | 52 |
| 101 | AB052620 | *Mus musculus* DDM36 | 4361 | 89 |
| 102 | M69245 | *Homo sapiens* pregnancy-specific beta-1-glycoprotein | 613 | 70 |
| 103 | X92841 | *Homo sapiens* MHC class I chain-related protein A | 588 | 100 |
| 104 | AF136401 | *Rattus norvegicus* TRP2 | 410 | 88 |
| 105 | AL031709 | *Homo sapiens* c316G12.4 (novel protein similar to API1 and API2 (apoptosis inhibitor 1 and 2 (MIHB, MIHC, IAP1, IAP2))) | 561 | 93 |
| 106 | Y38389 | Human secreted protein encoded by gene No. 4. | 152 | 90 |
| 107 | Y27582 | Human secreted protein encoded by gene No. 16. | 320 | 100 |
| 108 | AF130079 | *Homo sapiens* PRO2852 | 231 | 60 |
| 109 | J02818 | *Oryctolagus cuniculus* cytochrome P-450p-2 | 893 | 46 |
| 110 | Y07894 | Human secreted protein fragment encoded from gene 43. | 169 | 48 |
| 111 | AF119297 | *Homo sapiens* neuroendocrine-specific protein-like protein 1 | 240 | 97 |
| 112 | X56203 | *Plasmodium falciparum* liver stage antigen | 254 | 23 |
| 113 | Y76200 | Human secreted protein encoded by gene 77. | 262 | 100 |
| 114 | Y36270 | Human secreted protein encoded by gene 47. | 359 | 100 |
| 115 | AJ133120 | *Rattus norvegicus* Proline rich synapse associated protein 2 | 3938 | 93 |
| 116 | AL031709 | *Homo sapiens* c316G12.4 (novel protein similar to API1 and API2 (apoptosis inhibitor 1 and 2 (MIHB, MIHC, IAP1, IAP2))) | 299 | 84 |
| 117 | AL031709 | *Homo sapiens* c316G12.4 (novel protein similar to API1 and AP12 (apoptosis inhibitor 1 and 2 (MIHB, MIHC, IAP1, IAP2))) | 582 | 100 |
| 118 | AB018542 | *Homo sapiens* CD98 light chain | 1829 | 86 |
| 119 | AB012692 | *Homo sapiens* CAC-1 | 132 | 41 |
| 120 | AB021644 | *Homo sapiens* gonadotropin inducible transcription repressor-4 | 2050 | 57 |
| 121 | AF110776 | *Homo sapiens* adrenal gland protein AD-003 | 542 | 53 |
| 122 | AL391688 | *Homo sapiens* bA524D16A.2.1 (novel protein similar to mouse granuphilin-a) | 683 | 42 |
| 123 | AB042624 | *Homo sapiens* SIRP-b2 | 247 | 50 |
| 124 | AF019980 | *Dictyostelium discoideum* ZipA | 280 | 22 |
| 125 | U58917 | *Homo sapiens* IL-17 receptor | 266 | 30 |
| 126 | AK021852 | *Homo sapiens* unnamed protein product | 884 | 99 |
| 127 | AY007378 | *Homo sapiens* G-protein beta subunit-like protein | 1731 | 99 |
| 129 | AF195522 | *Trypanosoma cruzi* B-cell mitogen precursor | 345 | 39 |
| 130 | Z81587 | *Caenorhabditis elegans* contains similarity to Pfam domain: PF01363 (FYVE zinc finger), Score = 65.2, E-value = 1.9e-17, N = 1 | 276 | 42 |
| 131 | AF188700 | *Homo sapiens* actin filament associated protein | 844 | 43 |
| 132 | M77678 | *Mus musculus* NKR-P1 gene-40 protein | 118 | 26 |
| 133 | AF217226 | *Homo sapiens* zinc finger protein ZNF286 | 574 | 94 |
| 134 | L06505 | *Homo sapiens* ribosomal protein L12 | 841 | 99 |
| 135 | Y12902 | Human 5' EST secreted protein SEQ ID NO: 492. | 134 | 100 |
| 136 | L11672 | *Homo sapiens* zinc finger protein | 3059 | 60 |
| 137 | U47924 | *Homo sapiens* B-cell receptor associated protein | 925 | 100 |
| 138 | AC006271 | *Homo sapiens* BC319430_7 | 163 | 49 |
| 139 | AE000799 | *Methanothermobacter thermoautotrophicus* O-linked GlcNAc transferase | 151 | 37 |
| 140 | Y13037 | Human secreted protein encoded by 5' EST SEQ ID NO: 51. | 187 | 100 |
| 142 | AJ3271735 | *Homo sapiens* sprouty (Drosophila) homolog 3 | 170 | 32 |
| 143 | AF228917 | *Rattus norvegicus* small rec | 454 | 56 |
| 144 | U41552 | *Caenorhabditis elegans* Contains similarity to Pfam domain: PF00122 (E1–E2_ATPase), Score = 36.1, E-value = 8.1e-10, N = 4 | 127 | 50 |
| 145 | AL049569 | *Homo sapiens* dJ37C10.3 (novel ATPase) | 328 | 45 |
| 146 | AF109888 | *Macaca mulatta* sodium-calcium exchanger circular exon 2 transcript | 147 | 32 |
| 147 | AF217227 | *Homo sapiens* zinc finger protein ZNF287 | 1146 | 43 |
| 148 | B24426 | Human PR01286 protein sequence SEQ ID NO: 199. | 466 | 100 |

TABLE 2-continued

| SEQ ID NO: | ACCESSION NUMBER | DESCRIPTION | SMITH-WATERMAN SCORE | % IDENTITY |
|---|---|---|---|---|
| 149 | AB019120 | *Rattus norvegicus* seven transmembrane receptor | 1015 | 37 |
| 150 | AF062476 | *Mus musculus* retinoic acid-responsive protein; STRA6 | 190 | 72 |
| 151 | X64223 | *Mus musculus* Fc-E receptor II (Fc-ERII/CD23) | 138 | 34 |
| 152 | X83543 | *Homo sapiens* APXL | 412 | 41 |
| 153 | AF217289 | *Homo sapiens* cadherin 20 | 4170 | 99 |
| 154 | Y36310 | Human secreted protein encoded by gene 87. | 250 | 100 |
| 155 | D50577 | *Mesocricetus auratus* carboxylesterase precursor | 441 | 50 |
| 156 | AB027004 | *Homo sapiens* protein phosphatase | 229 | 41 |
| 157 | AF305071 | *Mus musculus* calsenilin-like protein | 1281 | 99 |
| 158 | Y13126 | Human secreted protein encoded by 5' EST SEQ ID NO: 140. | 160 | 96 |
| 159 | AB016215 | *Cyprinus carpio* complement C3-Q2 | 132 | 35 |
| 160 | AF294278 | *Homo sapiens* PR-domain-containing protein 16 | 6646 | 99 |
| 161 | AF305210 | *Homo sapiens* concentrative Na+– nucleoside cotransporter hCNT3 | 3609 | 100 |
| 163 | U10281 | *Sus scrofa* gastric mucin | 165 | 22 |
| 164 | M13095 | Rattus sp. 0–44 protein | 661 | 98 |
| 165 | AY008763 | *Homo sapiens* sentrin/SUMO-specific protease | 537 | 53 |
| 166 | S72304 | Mus ap. LMW G-protein | 763 | 94 |
| 167 | AF238315 | *Homo sapiens* HZFw1 protein | 2251 | 99 |
| 168 | M22414 | *Homo sapiens* ribonuclease inhibitor precursor | 222 | 30 |
| 169 | AL035702 | *Homo sapiens* dJ593C16.1 (ras GTPase activating protein) | 3010 | 58 |
| 170 | AL110500 | *Caenorhabditis elegans* Y87G2A.13 | 146 | 22 |
| 171 | AB028860 | *Mus musculus* mDj10 | 189 | 37 |
| 172 | M83653 | *Homo sapiens* cytoplasmic phosphotyrosyl protein phosphatase | 648 | 100 |
| 173 | AB041601 | *Mus musculus* unnamed protein product | 255 | 61 |
| 174 | M35012 | *Drosophila melanogaster* non-muscle myosin heavy chain | 200 | 24 |
| 175 | D88577 | *Mus musculus* Kupffer cell receptor | 904 | 46 |
| 176 | Y30847 | Human secreted protein encoded from gene 37. | 239 | 100 |
| 177 | Y01390 | Secreted protein encoded by gene 8 clone HTXDJ88. | 301 | 100 |
| 178 | M23725 | *Homo sapiens* M2-type pyruvate kinase | 152 | 78 |
| 179 | X72875 | *Homo sapiens* complement factor B | 3527 | 100 |
| 180 | Y08420 | *Homo sapiens* nicotinic acetylcholine receptor alpha7 subunit precursor | 1794 | 100 |
| 181 | M24766 | *Homo sapiens* alpha-2 type IV collagen | 3756 | 99 |
| 183 | AL110500 | *Caenorhabditis elegans* Y87G2A.13 | 180 | 25 |
| 184 | AF286598 | *Homo sapiens* angiostatin binding protein 1 | 1447 | 62 |
| 185 | Y13084 | Human secreted protein encoded by 5' EST SEQ ID NO: 98. | 130 | 62 |
| 186 | AF151067 | *Homo sapiens* HSPC233 | 892 | 58 |
| 187 | AL133283 | *Homo sapiens* bA31M2.1 (novel protein similar to the GLI family of zinc finger proteins) | 1629 | 100 |
| 188 | J03799 | *Homo sapiens* laminin-binding protein | 1331 | 94 |
| 189 | M27132 | *Homo sapiens* ATP synthase beta subunit precursor | 734 | 98 |
| 190 | M27132 | *Homo sapiens* ATP synthase beta subunit precursor | 206 | 100 |
| 191 | M27132 | *Homo sapiens* ATP synthase beta subunit precursor | 709 | 98 |
| 192 | M27132 | *Homo sapiens* ATP synthase beta subunit precursor | 1127 | 89 |
| 193 | U76638 | *Homo sapiens* BRCA1-associated RING domain protein | 4101 | 100 |
| 194 | U76638 | *Homo sapiens* BRCA1-associated RING domain protein | 394 | 100 |
| 195 | S57688 | *Thermotoga maritima* EF-G | 289 | 75 |
| 196 | U09453 | *Cricetulus griseus* UDP-N-acetylglucosamine: dolichyl phosphate N-acetylglucosamine 1-phosphate transferase | 239 | 85 |
| 197 | D86821 | *Streptomyces coelicolor* PrfB | 151 | 40 |
| 198 | Y36068 | Extended human secreted protein sequence, SEQ ID NO. 453. | 495 | 94 |
| 199 | U38980 | *Homo sapiens* hPMSR6 | 408 | 92 |
| 200 | Y08999 | *Homo sapiens* Sop2p-like protein | 572 | 99 |
| 201 | AJ401272 | *Canis familiaris* Band4.1-like5 protein | 2233 | 95 |
| 202 | U09608 | *Homo sapiens* cell surface protein | 292 | 84 |
| 203 | Y64747 | Human 5' EST related polypeptide SEQ ID NO: 908. | 471 | 96 |
| 204 | Y66754 | Membrane-bound protein PR01187. | 656 | 100 |
| 205 | U52111 | *Homo sapiens* Ca2+/Calmodulin-dependent protein kinase I | 1680 | 99 |
| 206 | AF279265 | *Homo sapiens* putative anion transporter 1 | 186 | 39 |
| 207 | X91911 | *Homo sapiens* rtvp-1 | 446 | 40 |
| 208 | X56390 | *Canis familiaris* rac2 | 508 | 100 |
| 209 | AK026888 | *Homo sapiens* unnamed protein product | 1536 | 100 |
| 210 | AK026888 | *Homo sapiens* unnamed protein product | 927 | 98 |
| 211 | AB044805 | *Homo sapiens* 6-phosphofructo-2-kinase heart isoform | 2452 | 100 |
| 212 | AB013897 | *Homo sapiens* HKR1 | 3083 | 99 |
| 213 | U37351 | *Mus musculus* Paneth cell enhanced expression PCEE | 746 | 89 |
| 214 | AJ278475 | *Homo sapiens* transport-secretion protein 2.1 (TTS-2.1) | 2179 | 98 |
| 215 | U58749 | *Caenorhabditis elegans* coded for by *C. elegans* cDNA yk8c7.5; coded for by *C. elegans* cDNA yk47c5.5; coded for by *C. elegans* cDNA yk76b5.5; coded for by *C. elegans* CDNA yk8c7.3; coded for by *C. elegans* CDNA yk47c5.3; strong similarity to catalytic domains of ser/thr protein kinases | 844 | 63 |

TABLE 2-continued

| SEQ ID NO: | ACCESSION NUMBER | DESCRIPTION | SMITH-WATERMAN SCORE | % IDENTITY |
|---|---|---|---|---|
| 216 | AF000195 | Caenorhabditis elegans Contains similarity to Pfam domain: PF00169 (PH), Score = 20.6, E-value = 1.9e-05, N = 1 | 1072 | 47 |
| 217 | AB016768 | Mus musculus thrombospondin type 1 domain | 189 | 40 |
| 218 | AB026256 | Homo sapiens organic anion transporter OATP-B | 1928 | 99 |
| 219 | X56692 | Homo sapiens C-reactive protein | 327 | 100 |
| 220 | AF064801 | Homo sapiens multiple membrane spanning receptor TRC8 | 603 | 29 |
| 221 | AF191545 | Homo sapiens aminopeptidase | 5048 | 99 |
| 222 | X66171 | Homo sapiens CMRF-35 antigen | 228 | 33 |
| 223 | Z38061 | Saccharomyces cerevisiae mal5, stal, len: 1367, CAI: 0.3, AMYH_YEAST P08640 GLUCOAMYLASE S1 (EC 3.2.1.3) | 241 | 22 |
| 224 | AC005306 | Homo sapiens R27216_1 | 1560 | 100 |
| 225 | AF176532 | Mus musculus F-box protein FBX17 | 1059 | 81 |
| 226 | AF097432 | Homo sapiens GROS1-L protein | 2147 | 99 |
| 227 | AF097432 | Homo sapiens GROS1-L protein | 1900 | 96 |
| 226 | AF097432 | Homo sapiens GROS1-L protein | 3881 | 99 |
| 229 | Z29094 | Caenorhabditis elegans contains similarity to Pfam domain: PF01699 (Sodium/calcium exchanger protein), Score = 268.7, E-value = 2.5e-77, N = 2 | 388 | 32 |
| 230 | Y66669 | Membrane-bound protein PRO839. | 366 | 100 |
| 231 | X75931 | Bos taurus Cleavage and Polyadenylation specificity factor (CPSF) 100 kD subunit | 4033 | 98 |
| 232 | AF152562 | Homo sapiens angiopoietin-related protein 3 | 1210 | 99 |
| 233 | L19686 | Homo sapiens macrophage migration inhibitory factor | 564 | 94 |
| 234 | AL008723 | Homo sapiens dj90G24.4 (SAAT1 (low affinity sodium glucose cotransporter (sodium:solute symporter family))) | 3408 | 100 |
| 235 | U50927 | Rattus norvegicus zinc transporter ZnT-2 | 1040 | 85 |
| 236 | AF099973 | Mus musculus schlafen2 | 982 | 53 |
| 237 | U67557 | Methanococcus jannaschii cell division control protein 48 (cdc48), AAA family | 1050 | 41 |
| 238 | AF207661 | Homo sapiens sodium bicarbonate cotransporter-like protein | 5645 | 100 |
| 239 | AF284337 | Homo sapiens SEBOX | 1209 | 100 |
| 240 | AF081669 | synthetic construct VU91B calmodulin | 109 | 42 |
| 241 | U96166 | Streptococcus cristatus srpA | 286 | 18 |
| 242 | AE005024 | Halobacterium sp. NRC-1 Vng0821c | 130 | 37 |
| 243 | AK023335 | Homo sapiens unnamed protein product | 2344 | 99 |
| 244 | AK024464 | Homo sapiens FLJ00057 protein | 3033 | 99 |
| 245 | U55376 | Caenorhabditis elegans coded for by C. elegans CDNA cm21e6; coded for by C. elegans CDNA cm01e2; similar to melibiose carrier protein (thiomethylgalactoeide permease II) | 752 | 40 |
| 246 | AK022660 | Homo sapiens unnamed protein product | 1173 | 99 |
| 247 | D16235 | Bos taurus PLC alpha | 156 | 24 |
| 248 | B08894 | Human secreted protein sequence encoded by gene 4 SEQ ID NO: 51. | 235 | 67 |
| 249 | AJ289709 | HERV-H/env62 envelope protein | 754 | 39 |
| 250 | AJ242540 | Volvox carteri f. nagariensis hydroxyproline-rich glycoprotein DZ-HRGP | 209 | 63 |
| 251 | Y66747 | Membrane-bound protein PRO1158. | 609 | 100 |
| 252 | AL031532 | Schizosaccharomyces pombe ubiquitin conjugating enzyme | 236 | 41 |
| 253 | W74899 | Human secreted protein encoded by gene 172 clone HODCW06. | 197 | 100 |
| 254 | D43633 | Oryzias latipes G protein-coupled seven-transmembrane receptor | 462 | 36 |
| 255 | D43633 | Oryzias latipes G protein-coupled seven-transmembrane receptor | 823 | 42 |
| 256 | AJ277750 | Homo sapiens UBASH3A protein | 1035 | 44 |
| 257 | Y12711 | Homo sapiens putative progesterone binding protein | 187 | 42 |
| 258 | W74939 | Human secreted protein encoded by gene 49 clone HAGBI17. | 211 | 100 |
| 259 | D16432 | Mus musculus murine homologue of CD63/ME491 | 504 | 99 |
| 260 | AB031051 | Homo sapiens organic anion transporter OATP-E | 863 | 37 |
| 261 | J03998 | Plasmodium falciparum glutamic acid-rich protein | 139 | 29 |
| 262 | U80953 | Caenorhabditis elegans weakly similar in serine repeat region to rat thyroxine-binding globulin (PIR:A39567) and to D. melanogaster ecdysone-inducible protein E75-C (SP:E75C_DROME, P13055) | 336 | 32 |
| 263 | AF155662 | Homo sapiens putative 16.7 kDa protein | 766 | 99 |
| 264 | Z46237 | Saccharomyces cerevisiae putative protein | 245 | 27 |
| 265 | Z46237 | Saccharomyces cerevisiae putative protein | 245 | 27 |
| 266 | AF208795 | Ictalurus punctatus NCC receptor protein 1 | 286 | 50 |
| 267 | AJ249901 | Mus musculus secreted modular calcium-binding protein 2 | 2332 | 95 |
| 268 | X05908 | Homo sapiens lipocortin (AA 1–346) | 967 | 100 |
| 269 | X05908 | Homo sapiens lipocortin (AA 1–346) | 1511 | 100 |
| 270 | X05908 | Homo sapiens lipocortin (AA 1–346) | 967 | 100 |
| 271 | AC003038 | Homo sapiens R30923_1 | 2992 | 100 |
| 273 | U37143 | Homo sapiens cytochrome P450 monooxygenase CYP2J2 | 942 | 44 |
| 274 | U37143 | Homo sapiens cytochrome P450 monooxygenase CYP2J2 | 555 | 45 |
| 275 | AF154933 | Sus scrofa complement component C3 | 374 | 39 |
| 276 | Z54342 | Caenorhabditis elegans contains similarity to Pfam domain: PF00328 (Histidine acid pliosphatase), Score = 511.8, E-value = 2e-152, N = 1 | 570 | 39 |

TABLE 2-continued

| SEQ ID NO: | ACCESSION NUMBER | DESCRIPTION | SMITH-WATERMAN SCORE | % IDENTITY |
|---|---|---|---|---|
| 277 | M20259 | *Homo sapiens* thymosin beta-10 | 169 | 97 |
| 278 | Y91386 | Human secreted protein sequence encoded by gene 41 SEQ ID NO: 107. | 558 | 100 |
| 279 | AF151110 | *Mus musculus* COP1 protein | 2268 | 99 |
| 280 | AF117959 | *Homo sapiens* CDK4-binding protein p34SEI1 | 114 | 68 |
| 281 | Y91370 | Human secreted protein sequence encoded by gene 25 SEQ ID NO: 91. | 293 | 100 |
| 282 | AF079446 | *Dictyostelium discoideum* developmental protein DG1067 | 520 | 38 |
| 283 | M60618 | *Homo sapiens* nuclear autoantigen | 300 | 84 |
| 284 | D83777 | *Homo sapiens* expressed ubiquitously with strong expression in brain | 912 | 51 |
| 285 | L77864 | *Homo sapiens* stat-like protein | 290 | 96 |
| 286 | Y02775 | Human secreted protein encoded by gene 12 clone HFTCU19. | 288 | 98 |
| 287 | L21998 | *Homo sapiens* mucin | 389 | 24 |
| 288 | AF184275 | *Mus musculus* F-box protein FBX18 | 4409 | 92 |
| 289 | AF053356 | *Homo sapiens* leucin rich neuronal protein | 264 | 37 |
| 290 | AC016829 | *Arabidopsis thaliana* putative O-linked GlcNAC transferase | 377 | 27 |
| 291 | Y73414 | Human secreted protein clone yb101_1 protein sequence SEQ ID NO: 50. | 472 | 100 |
| 292 | W88611 | Secreted protein encoded by gene 82 clone HNGBT31. | 525 | 97 |
| 293 | AJ278018 | *Homo sapiens* calsyntenin-2 | 5080 | 100 |
| 294 | Y41460 | Fragment of human secreted protein encoded by gene 42. | 1034 | 100 |
| 295 | D79995 | *Homo sapiens* similar to pig tubulin-tyrosine ligase. | 415 | 42 |
| 296 | AF092878 | *Homo sapiens* zinc RING finger protein SAG | 323 | 92 |
| 297 | AL137784 | *Homo sapiens* dJ199J3.1 (novel protein similar to ubiquitin carboxyl - terminal hydrolase 16 (EC 3.1.2.15)) | 561 | 100 |
| 298 | Z70310 | *Caenorhabditis elegans* contains similarity to Pfam domain: PF00013 (KH domain), Score = 42.8, E-value = 3.7e-12, N = 1; PF00023 (Ank repeat), Score = 428.2, E-value = 2.4e-125, N = 19 | 520 | 37 |
| 299 | Y48600 | Human breast tumour-associated protein 61. | 288 | 98 |
| 300 | AB007889 | *Homo sapiens* KIAA0429 | 386 | 46 |
| 301 | U64601 | *Caenorhabditis elegans* Gene probably begins in the next cosmid | 412 | 50 |
| 302 | U27109 | *Homo sapiens* prepromultimerin | 208 | 24 |
| 304 | AF278532 | *Homo sapiens* beta-netrin | 3347 | 99 |
| 305 | X51957 | *Homo sapiens* muscle-specific enolase | 555 | 94 |
| 306 | Y07895 | Human secreted protein fragment encoded from gene 44. | 537 | 100 |
| 307 | AE001045 | *Archaeoglobus fulgidus* proliferating-cell nucleolar antigen P120, putative | 144 | 41 |
| 308 | AB033882 | *Coturnix japonica* protein kinase C inhibitor | 433 | 60 |
| 309 | AC006284 | *Arabidopsis thaliana* putative ankyrin | 198 | 44 |
| 310 | AF093673 | *Cricetulus griseus* layilin | 576 | 45 |
| 311 | J02642 | *Homo sapiens* glyceraldehyde 3-phosphate dehydrogenase (EC 1.2.1.12) | 1685 | 97 |
| 312 | AB012692 | *Homo sapiens* CAC-1 | 560 | 94 |
| 313 | AB012692 | *Homo sapiens* CAC-1 | 484 | 73 |
| 314 | Y17571 | *Homo sapiens* aralar2 | 300 | 48 |
| 315 | X15324 | *Homo sapiens* angiotensinogen | 1925 | 97 |
| 316 | X97321 | *Homo sapiens* HLA-C protein | 1099 | 98 |
| 317 | M24036 | *Homo sapiens* MHC HLA-B8 chain | 1033 | 92 |
| 318 | U04245 | *Homo sapiens* MHC class I antigen | 940 | 95 |
| 319 | M32318 | *Homo sapiens* HLA protein allele B57 | 982 | 88 |
| 320 | U41057 | *Homo sapiens* HLA class I A locus antigen A*68new | 1801 | 93 |
| 321 | M32321 | *Homo sapiens* HLA protein allele A25 | 1163 | 96 |
| 322 | AJ250917 | *Homo sapiens* human leucocyte antigen B | 315 | 88 |
| 323 | D64147 | *Homo sapiens* HLA-Cw*0602 | 1121 | 96 |
| 324 | AB005048 | *Homo sapiens* A26null allele | 977 | 85 |
| 325 | M24043 | *Homo sapiens* MHC HLA-A1 chain | 1123 | 97 |
| 326 | AF190900 | *Homo sapiens* kelch-like protein C3IP1 | 2982 | 100 |
| 327 | AB022023 | *Bos taurus* nonmuscle myosin heavy chain B | 158 | 22 |
| 328 | X85019 | *Homo sapiens* UDP-GalNAC:polypeptide N-acetylgalactosaminyl transferase | 1431 | 50 |
| 329 | W58985 | *Homo sapiens* adult brain clone BV141_2 encoded protein. | 201 | 100 |
| 330 | Y14455 | Human secreted protein encoded by gene 45 clone HCFBJ91. | 284 | 100 |
| 331 | M25757 | *Bos taurus* GTP:AMP phosphotransferase (EC 2.7.4.10) | 127 | 73 |
| 332 | AF037402 | *Bos taurus* butyrophilin | 225 | 25 |
| 333 | X99211 | *Drosophila melanogaster* ubiquitin-specific protease | 846 | 68 |
| 334 | Y36160 | Human secreted protein #32. | 500 | 100 |
| 335 | W67869 | Human secreted protein encoded by gene 63 clone HHGDB72. | 454 | 91 |
| 336 | X15334 | *Homo sapiens* creatine kinase B | 162 | 71 |
| 337 | AL109658 | *Homo sapiens* dJ776F14.1 (ortholog of mouse P47) | 310 | 50 |
| 338 | AL109658 | *Homo sapiens* dJ776F14.1 (ortholog of mouse P47) | 797 | 55 |
| 339 | AJ001309 | *Homo sapiens* DnaJ protein | 659 | 100 |
| 340 | AF096870 | *Homo sapiens* estrogen-responsive B box protein | 465 | 28 |
| 341 | L33243 | *Homo sapiens* polycystic kidney disease 1 protein | 20117 | 99 |
| 342 | Z83850 | *Homo sapiens* mouse NIK serine threonine protein kinase like; match: proteins P97820 CE02384 | 1582 | 95 |
| 343 | AF201084 | *Secale cereale* secalin precursor | 149 | 29 |
| 344 | L16685 | *Caenorhabditis elegans* homology with breakpoint cluster region protein; putative | 549 | 41 |

TABLE 2-continued

| SEQ ID NO: | ACCESSION NUMBER | DESCRIPTION | SMITH-WATERMAN SCORE | % IDENTITY |
|---|---|---|---|---|
| 345 | AL162458 | Homo sapiens bA465L10.4 (matrix metalloproteinase 9 (gelatinase B, 92 kD gelatinase, 92 kD type IV collagenase) (CLG4B)) | 2489 | 94 |
| 346 | AX011001 | Homo sapiens MMP-9 | 2375 | 100 |
| 347 | X89416 | Homo sapiens protein phosphatase 5 | 451 | 87 |
| 348 | Y64786 | Human 5' EST related polypeptide SEQ ID NO: 947. | 200 | 100 |
| 349 | AC005167 | Arabidopsis thaliana putative ubiquitin-conjugating enzyme | 509 | 44 |
| 350 | AF074901 | Caenorhabditis elegans hemicentin precursor | 1205 | 29 |
| 351 | U12623 | Rattus norvegicus cyclic nucleotide gated cation channel | 2811 | 93 |
| 352 | AF245516 | Drosophila melanogaster Ran binding protein 9 | 140 | 40 |
| 353 | AF300649 | Homo sapiens regulator of G-protein signaling | 926 | 100 |
| 354 | X16396 | Homo sapiens precursor polypeptide (AA −29 to 315) | 855 | 80 |
| 355 | S70290 | Homo sapiens glutamine synthetase, GS {EC 6.3.1.2} | 1787 | 100 |
| 356 | X59834 | Homo sapiens glutamate-ammonia ligase | 435 | 89 |
| 357 | X84801 | Homo sapiens ZNF165 | 467 | 55 |
| 358 | AL365234 | Arabidopsis thaliana putative protein | 224 | 34 |
| 359 | AJ272034 | Homo sapiens putative capacitative calcium channel | 4470 | 100 |
| 360 | AJ007798 | Homo sapiens stromal antigen 3, (STAG3) | 278 | 74 |
| 361 | AJ007798 | Homo sapiens stromal antigen 3, (STAG3) | 292 | 82 |
| 362 | AF193807 | Homo sapiens Rh type B glycoprotein | 2176 | 99 |
| 363 | AC006963 | Homo sapiens similar to Kelch proteins; similar to BAA77027 (PID:g4650844) | 895 | 37 |
| 364 | Y86297 | Human secreted protein HLDCE79, SEQ ID NO: 212. | 530 | 100 |
| 365 | AB039903 | Homo sapiens interferon-responsive finger protein 1 long form | 4302 | 99 |
| 366 | AF143003 | Perca flavescens lysyl oxidase related protein homolog | 410 | 55 |
| 367 | AF151840 | Homo sapiens CGI-82 protein | 1166 | 71 |
| 368 | AB036834 | Drosophila melanogaster MAP kinase phosphate | 188 | 41 |
| 369 | M30262 | Homo sapiens preprocardiodilatin-atrial natriuretic factor | 771 | 100 |
| 370 | AF135253 | Mus musculus fibulin-2 | 386 | 41 |
| 371 | AF112361 | Schmidtea mediterranea opsin | 109 | 32 |
| 372 | X89416 | Homo sapiens protein phosphatase 5 | 387 | 100 |
| 373 | M96256 | Homo sapiens rapamycin binding protein | 1169 | 100 |
| 374 | AF121859 | Homo sapiens sorting nexin 9 | 660 | 43 |
| 375 | Y07566 | Homo sapiens RIT (Ric-related gene expressed in many tissues) | 266 | 28 |
| 376 | AF208291 | Homo sapiens protein kinase HIPK2 | 6242 | 99 |
| 377 | AF170301 | Mus musculus nuclear body associated kinase 1a | 5972 | 97 |
| 378 | AL133230 | Homo sapiens dJ530I15.2 (novel protein similar to placental protein DIFF40) | 1170 | 99 |
| 379 | AB001928 | Homo sapiens cathepsin V | 656 | 98 |
| 380 | AB001928 | Homo sapiens cathepsin V | 725 | 90 |
| 381 | Y87329 | Human signal peptide containing protein HSPP-106 SEQ ID NO: 106. | 692 | 94 |
| 382 | AL356276 | Homo sapiens bA367J7.2.1 (novel Immunoglobulin domains containing protein (isoform 1)) | 479 | 51 |
| 383 | AK024551 | Homo sapiens unnamed protein product | 824 | 100 |
| 384 | U70851 | Caenorhabditis elegans similar to S. cerevisiae protein transport protein SEC7 (SP:P11075) | 612 | 39 |
| 385 | D83348 | Rattus norvegicus long type PB-cadherin | 3904 | 92 |
| 386 | AF162149 | Mycoplasma bovis variable surface lipoprotein | 216 | 46 |
| 387 | U96149 | Mus musculus perforatorial protein PERF 15 | 481 | 68 |
| 388 | U12535 | Homo sapiens epidermal growth factor receptor kinase substrate | 1051 | 46 |
| 389 | U00059 | Saccharomyces cerevisiae Yhr116wp | 114 | 41 |
| 390 | U70369 | Mus musculus hematopoietic-specific IL-2 deubiquitinating enzyme | 873 | 47 |
| 391 | AF247679 | Xenopus laevis putative N-terminal acetyltransferase | 978 | 57 |
| 392 | AB007646 | Arabidopsis thaliana UVB-resistance protein UVR8 | 315 | 31 |
| 393 | AF026246 | Homo sapiens HERV-E envelope glycoprotein | 361 | 91 |
| 394 | AF198489 | Homo sapiens LBP-32 | 1747 | 57 |
| 395 | Y91356 | Human secreted protein sequence encoded by gene 11 SEQ ID NO: 77. | 801 | 100 |
| 396 | Y94978 | Human secreted protein clone pw337_6 2nd protein sequence SEQ ID NO: 238. | 444 | 100 |
| 397 | AC005996 | Homo sapiens similar to Xenopus laevis gamma-crystallin 6; similar to AF071563 (PID:g3930581) | 818 | 100 |
| 398 | Y76216 | Human secreted protein encoded by gene 93. | 225 | 97 |
| 399 | Y11447 | Human 5' EST secreted protein SEQ ID No 269. | 210 | 97 |
| 400 | U12392 | Haematobia irritans putative ATPase | 917 | 49 |
| 401 | U12392 | Haematobia irritans putative ATPase | 609 | 49 |
| 402 | AF002109 | Arabidopsis thaliana putative ABC transporter | 487 | 40 |
| 403 | AF110645 | Homo sapiens candidate tumor suppressor p33 ING1 homolog | 860 | 69 |
| 404 | J03941 | Mus musculus ferritin heavy chain | 947 | 100 |
| 405 | AL023513 | Homo sapiens dJ268D13.1.1 (seizure related gene 6 (mouse)-like (KIAA0927) (isoform 1)) | 808 | 46 |
| 407 | D87458 | Homo sapiens Similar to Human estrogen-responsive finger protein, efp (A49656) | 2575 | 99 |
| 408 | AJ278475 | Homo sapiens transport-secretion protein 2.1 (TTS-2.1) | 346 | 98 |
| 409 | AF282886 | Homo sapiens heparanase-like protein HPA2b | 2785 | 100 |

TABLE 2-continued

| SEQ ID NO: | ACCESSION NUMBER | DESCRIPTION | SMITH-WATERMAN SCORE | % IDENTITY |
|---|---|---|---|---|
| 410 | AF015454 | *Xenopus laevis* ER1 | 777 | 42 |
| 411 | AF163762 | *Homo sapiens* zinc metalloendopeptidase | 5940 | 99 |
| 412 | Z34277 | *Homo sapiens* mucin | 978 | 95 |
| 413 | Y76179 | Human secreted protein encoded by gene 56. | 634 | 100 |
| 414 | AF168362 | *Rattus norvegicus* protein associating with small stress protein PASS1 | 232 | 68 |
| 415 | AF156777 | *Homo sapiens* ASB-1 protein | 486 | 39 |
| 416 | AK024169 | *Homo sapiens* unnamed protein product | 752 | 100 |
| 417 | Y08625 | Human secreted protein BL341 4. | 367 | 100 |
| 418 | AB026803 | *Mus musculus* synaptotagmin VI | 2153 | 96 |
| 419 | AB026803 | *Mus musculus* synaptotagmin VI | 2098 | 94 |
| 420 | AJ278474 | *Sus scrofa* cytochrome P450 | 1316 | 50 |
| 421 | W78135 | Human secreted protein encoded by gene 10 clone HPNGQ80. | 385 | 100 |
| 422 | U70476 | *Rattus norvegicus* cationic amino acid transporter-1 | 646 | 62 |
| 423 | AF188634 | *Drosophila melanogaster* F protein | 546 | 55 |
| 424 | AJ132889 | *Mus musculus* kinesin like protein 9 | 3618 | 88 |
| 425 | D86983 | *Homo sapiens* similar to *D. melanogaster* peroxidasin (U11052) | 328 | 32 |
| 426 | AL035464 | *Homo sapiens* dJ1043E3.1 (novel protein) | 945 | 99 |
| 427 | ALC34380 | *Homo sapiens* dJ50O24.4 (novel protein with DHHC zinc finger domain) | 1131 | 67 |
| 428 | AJ400877 | *Homo sapiens* CEGP1 protein | 5605 | 100 |
| 429 | AF060570 | *Mus musculus* rig-1 protein | 1545 | 73 |
| 430 | Y02697 | Human secreted protein encoded by gene 48 clone HTNBR95. | 165 | 100 |
| 431 | Y73386 | HTRM clone 3279329 protein sequence. | 529 | 100 |
| 432 | AF279890 | *Homo sapiens* 2P domain potassium channel TREK2 | 2760 | 100 |
| 433 | AB023658 | *Rattus norvegicus* Ca/calmodulin-dependent protein kinase kinase alpha, CaM-kiriase kinase alpha | 2468 | 93 |
| 434 | J05056 | *Oryctolagus cuniculus* oxysterol-binding protein | 181 | 42 |
| 435 | Y99437 | Human PRO1508 (UNQ761) amino acid sequence SEQ ID NO: 336. | 672 | 83 |
| 436 | AF043179 | *Homo sapiens* T cell receptor beta chain | 681 | 73 |
| 437 | AF151042 | *Homo sapiens* HSPC208 | 585 | 79 |
| 438 | Y87328 | Human signal peptide containing protein HSPP-105 SEQ ID NO: 105. | 681 | 100 |
| 439 | Y66734 | Membrane-bound protein PRO1097. | 297 | 70 |
| 440 | D78572 | *Mus musculus* membrane glycoprotein | 262 | 28 |
| 441 | L20315 | *Mus musculus* MPS1 protein | 2716 | 77 |
| 442 | Y19588 | Amino acid sequence of a human secreted protein. | 329 | 100 |
| 443 | AF306550 | *Sinorhizobium meliloti* (p)ppGpp synthetase | 213 | 36 |
| 444 | M38379 | *Arabidopsis thaliana* calmodulin-1 | 108 | 37 |
| 445 | Y12512 | Human 5' EST secreted protein SEQ ID NO: 543. | 320 | 98 |
| 446 | AC013482 | *Arabidopsis thaliana* T26F17.15 | 309 | 37 |
| 447 | AC013482 | *Arabidopsis thaliana* T26F17.15 | 289 | 35 |
| 448 | AL035703 | *Homo sapiens* dJ61A9.1 (tyrosine kinase) | 5326 | 99 |
| 449 | X59720 | *Saccharomyces cerevisiae* YCR017C, len: 953 | 731 | 30 |
| 450 | AL035526 | *Arabidopsis thaliana* extensin-like protein | 154 | 33 |
| 451 | U16282 | *Homo sapiens* ELL | 147 | 29 |
| 452 | M80537 | *Drosophila melanogaster* fat protein | 207 | 28 |
| 453 | AB029334 | *Halocynthia roretzi* HrPET-1 | 687 | 38 |
| 454 | AL031349 | *Schizosaccharomyces pombe* putative vesicular transport protein | 643 | 28 |
| 455 | AB041533 | *Homo sapiens* sperm antigen | 3737 | 98 |
| 456 | U27109 | *Homo sapiens* prepromultimerin | 208 | 24 |
| 457 | AJ010949 | *Mus musculus* calcium channel alpha-2-delta-C subunit | 225 | 22 |
| 458 | AJ271643 | *Homo sapiens* putative acid-sensing ion channel | 2893 | 100 |
| 459 | G02479 | Human secreted protein, SEQ ID NO: 6560. | 442 | 100 |
| 460 | D16111 | *Homo sapiens* human homologue of rat phosphatidylethanolamine binding protein | 846 | 98 |
| 461 | AF180470 | *Mus musculus* Kiaa0575 | 1139 | 57 |
| 462 | Z54270 | *Caenorhabditis elegans* F11C1.4 | 183 | 33 |
| 463 | AB019527 | *Homo sapiens* LDOC1 protein | 129 | 31 |
| 464 | U58105 | *Mus musculus* Murine homolog of human ftp-3 | 303 | 36 |
| 465 | AF172449 | *Homo sapiens* opioid growth factor receptor | 325 | 47 |
| 466 | AL035106 | *Homo sapiens* dJ998C11.1 (continues in Em:AL445192 as bA269H4.1) | 2438 | 58 |
| 467 | AC004561 | *Arabidopsis thaliana* putative proline-rich protein | 256 | 29 |
| 468 | AF000174 | *Caenorhabditis elegans* weak similarity to HSP90 | 144 | 28 |
| 469 | X59720 | *Saccharomyces cerevisiae* YCR016W, len: 290 | 128 | 26 |
| 470 | AF027219 | *Homo sapiens* ZNF202 beta | 620 | 32 |
| 471 | AF122924 | *Xenopus laevis* Wnt inhibitory factor-1 | 484 | 44 |
| 472 | X67704 | *Drosophila melanogaster* sperm protein | 111 | 32 |
| 473 | AF317889 | *Homo sapiens* NOX5 | 3015 | 99 |
| 474 | L46815 | *Mus musculus* DNA binding protein Rc | 6027 | 77 |
| 475 | AF190665 | *Mus musculus* LMBR1 long form | 2391 | 96 |
| 476 | AF041382 | *Drosophila melanogaster* microtubule binding protein D-CLIP-190 | 244 | 33 |
| 477 | AL033545 | *Arabidopsis thaliana* putative protein | 138 | 49 |
| 478 | Z98745 | *Homo sapiens* dJ29K1.2 | 1123 | 56 |
| 479 | AL118502 | *Homo sapiens* bA371L19.1 (novel protein) | 2471 | 100 |
| 480 | Z94160 | *Homo sapiens* dJ63G5.3 (putative Leucine rich protein) | 953 | 100 |
| 481 | X98263 | *Homo sapiens* M-phase phosphoprotein 6 | 469 | 93 |

TABLE 2-continued

| SEQ ID NO: | ACCESSION NUMBER | DESCRIPTION | SMITH-WATERMAN SCORE | % IDENTITY |
|---|---|---|---|---|
| 482 | B08904 | Human secreted protein sequence encoded by gene 14 SEQ ID NO: 61. | 239 | 100 |
| 483 | AY007233 | *Homo sapiens* phosphoinositol 3-phosphate binding protein-1 | 3830 | 99 |
| 484 | AY007233 | *Homo sapiens* phosphoinositol 3-phosphate binding protein-1 | 4152 | 99 |
| 485 | Y94947 | Human secreted protein clone cw1292_8 protein sequence SEQ ID NO: 100. | 408 | 100 |
| 486 | J03614 | *Oryctolagus cuniculus* myosin heavy chain | 225 | 26 |
| 487 | AB026256 | *Homo sapiens* organic anion transporter OATP-B | 188 | 92 |
| 488 | AJ277748 | *Rattus norvegicus* NTPDase6 | 501 | 96 |
| 489 | U02289 | *Caenorhabditis elegans* GTPase-activating protein | 551 | 36 |
| 490 | B08894 | Human secreted protein sequence encoded by gene 4 SEQ ID NO: 51. | 211 | 69 |
| 491 | AF238862 | *Xenopus laevis* Churchill protein | 495 | 71 |
| 492 | D87076 | *Homo sapiens* similar to human bromodomain protein BR140 (JC2069) | 107 | 30 |
| 493 | A11959 | synthetic construct PP4X | 1122 | 99 |
| 494 | Y87252 | Human signal peptide containing protein HSPP-29 SEQ ID NO: 29. | 391 | 100 |
| 495 | AF015565 | *Dictyostelium discoideum* VacA | 245 | 31 |
| 496 | AF305427 | *Mus musculus* cAMP-dependent protein kinase regulatory subunit | 940 | 78 |
| 497 | K02581 | *Homo sapiens* thymidine kinase (EC 2.7.1.21) | 1216 | 99 |
| 498 | AB048364 | *Mus musculus* osteoblast differentiation promoting factor | 1017 | 46 |
| 499 | AJ006239 | *Homo sapiens* dihydropteridine reductase | 933 | 100 |
| 500 | Y59795 | Human normal ovarian tissue derived protein 72. | 554 | 100 |
| 501 | AL109965 | *Homo sapiens* dJ1121G12.1.2 (A novel protein containing a putative PHD finger domain, isoform 2) | 537 | 54 |
| 502 | Y12021 | Human 5' EST secreted protein SEQ ID NO: 334. | 265 | 97 |
| 503 | G01878 | Human secreted protein, SEQ ID NO: 5959. | 348 | 92 |
| 504 | AL023777 | *Schizosaccharomyces pombe* putative RNA-binding protein | 318 | 39 |
| 505 | M11902 | *Mus musculus* proline-rich salivary protein | 109 | 45 |
| 506 | J01998 | AKV murine leukemia virus gag-pol polyprotein (tag amber codon at 2250–2252 inserts Gln in Mo-MuLV) | 621 | 42 |
| 507 | AC012396 | *Arabidopsis thaliana* tumor-related protein, putative | 154 | 45 |
| 508 | X06160 | *Homo sapiens* precursor polypeptide (AA −24 to 140) | 742 | 97 |
| 509 | Y99351 | Human PRO1481 (UNQ750) amino acid sequence SEQ ID NO: 41. | 1725 | 100 |
| 510 | M22760 | *Homo sapiens* cytochrome c oxidase subunit Va | 461 | 97 |
| 511 | AF199008 | *Mus musculus* PALS1 | 3396 | 96 |
| 512 | AF145021 | *Mus musculus* exportin 4 | 3814 | 98 |
| 513 | AF119837 | *Cyprinus carpio* hexokinase I | 2020 | 75 |
| 514 | Z69043 | *Homo sapiens* translocon-associated protein delta subunit precursor | 459 | 98 |
| 515 | AF276512 | *Homo sapiens* RNA polymerase II elongation factor ELL3 | 2071 | 99 |
| 516 | M34379 | *Homo sapiens* elastase/medullasin precursor (EC 3.4.21.37) | 1320 | 96 |
| 517 | Y11385 | Human 5' EST secreted protein SEQ ID No 207. | 220 | 100 |
| 518 | AF045022 | *Bos taurus* phosphatidic acid-preferring phospholipase A1 | 4254 | 91 |
| 519 | U00031 | *Caenorhabditis elegans* Contains similarity to Pfam domain: PF00957 (synaptobrevin), Score = 100.3, E-value = 1.2e-26, N = 1 | 980 | 47 |
| 520 | X92098 | *Homo sapiens* transmembrane protein | 597 | 89 |
| 521 | X92098 | *Homo sapiens* transmembrane protein | 1003 | 96 |
| 522 | X57346 | *Homo sapiens* HS1 | 1218 | 95 |
| 523 | AF207901 | *Xenopus laevis* cingulin | 317 | 24 |
| 524 | AL035678 | *Arabidopsis thaliana* putative protein | 246 | 36 |
| 525 | Y30721 | Amino acid sequence of a human secreted protein. | 231 | 100 |
| 526 | AL035659 | *Homo sapiens* dJ979N1.1 (dJ979N1.1) | 1822 | 47 |
| 527 | AL035548 | *Schizosaccharomyces pombe* putative ribose methyltransferase | 263 | 38 |
| 528 | AB015617 | *Homo sapiens* ELKS | 3464 | 72 |
| 529 | L25665 | *Homo sapiens* GTP-binding protein | 2227 | 99 |
| 530 | Y11794 | Human 5' EST secreted protein SEQ ID No: 394. | 375 | 100 |
| 531 | Y14685 | *Arabidopsis thaliana* polynucleotide phosphorylase | 1375 | 40 |
| 532 | X52574 | *Mus musculus* GTP binding protein | 4571 | 91 |
| 533 | AB040119 | *Homo sapiens* mitochondrial import receptor Tom22 | 718 | 100 |
| 534 | U23822 | *Danio rerio* collagen II A1 | 295 | 43 |
| 535 | U39621 | *Gallus gallus* type V collagen | 371 | 46 |
| 536 | X79682 | *Felis catus* neuronal protein | 617 | 96 |
| 537 | AF099935 | *Homo sapiens* MDC-3.13 isoform 2 | 532 | 55 |
| 538 | AF145672 | *Drosophila melanogaster* BcDNA.GH12174 | 230 | 36 |
| 539 | AL035709 | *Arabidopsis thaliana* putative protein | 572 | 37 |
| 540 | AL022104 | *Schizosaccharomyces pombe* putative pre-mrna splicing factor rna helicase | 431 | 31 |
| 541 | AF113615 | *Homo sapiens* FH1/FH2 domain-containing protein FHOS | 1138 | 55 |
| 542 | U85494 | *Zea mays* LON1 protease | 1797 | 47 |
| 543 | X54162 | *Homo sapiens* 64 Kd autoantigen | 587 | 38 |
| 544 | AB037158 | *Homo sapiens* DSCR6a | 165 | 40 |
| 545 | Y07754 | Human secreted protein fragment encoded from gene 11. | 1723 | 100 |
| 546 | AL009171 | *Drosophila melanogaster* 62D9.o | 184 | 33 |
| 547 | M18963 | *Homo sapiens* islet regenerating protein | 817 | 89 |
| 548 | U29463 | *Homo sapiens* cytochrome b561 | 1125 | 91 |
| 549 | Z25420 | *Gallus gallus* class II INCENP protein | 237 | 26 |
| 550 | AL031324 | *Schizosaccharomyces pombe* membrane atpase | 1150 | 41 |
| 551 | AF145609 | *Drosophila melanogaster* BcDNA.GH02833 | 666 | 41 |
| 552 | AF302079 | *Homo sapiens* HSP22-like protein interacting protein 17 | 459 | 100 |
| 553 | AJ242730 | *Homo sapiens* polyhomeotic 2 | 451 | 59 |

TABLE 2-continued

| SEQ ID NO: | ACCESSION NUMBER | DESCRIPTION | SMITH-WATERMAN SCORE | % IDENTITY |
|---|---|---|---|---|
| 554 | U88167 | *Caenorhabditis elegans* contains similarity to C2 domains | 428 | 45 |
| 555 | AF156779 | *Homo sapiens* ASB-4 protein | 513 | 33 |
| 556 | AF305081 | *Homo sapiens* tankyrase-related protein | 5992 | 98 |
| 557 | AB028968 | *Homo sapiens* KIAA1045 protein | 2090 | 99 |
| 558 | AB028968 | *Homo sapiens* KIAA1045 protein | 1448 | 99 |
| 559 | AJ250998 | *Mucor circinelloides* carotenoid regulatory protein | 381 | 40 |
| 560 | AL109804 | *Homo sapiens* dJ1009E24.1.1 (A novel protein similar to the mouse sialoadhesin, a macrophage sialic acid binding receptor, isoform 1) | 6334 | 99 |
| 561 | Y76539 | Human ovarian tumor EST fragment encoded protein 35. | 261 | 98 |
| 562 | L07765 | *Homo sapiens* carboxylesterase | 209 | 51 |
| 563 | Z38061 | *Saccharomyces cerevisiae* mal5, stal, len: 1367, CAI: 0.3, AMYH_YEAST P08640 GLUCOAMYLASE S1 (EC 3.2.1.3) | 206 | 21 |
| 564 | AY009133 | *Homo sapiens* FYVE-finger-containing Rab5 effector protein Rabenosyn-5 | 4027 | 99 |
| 565 | AF287478 | *Lytechinus variegatus* embryonic blastocoelar extracellular matrix protein precursor | 1116 | 35 |
| 566 | AF223427 | *Xenopus laevis* RRM-containing protein SEB-4 | 793 | 88 |
| 567 | AP000693 | *Homo sapiens* partial CDS | 470 | 56 |
| 568 | AJ131244 | *Homo sapiens* Sec24A protein | 5357 | 98 |
| 569 | Y12049 | Human 5' EST secreted protein SEQ ID NO: 362. | 253 | 92 |
| 570 | AF255342 | *Homo sapiens* putative pheromone receptor V1RL1 long form | 1859 | 99 |
| 571 | Y99355 | Human PRO1295 (UNQ664) amino acid sequence SEQ ID NO: 54. | 1265 | 100 |
| 572 | ACC02397 | *Mus musculus* C9 | 678 | 51 |
| 573 | M28821 | *Mus musculus* Tcte-1 peptide | 1884 | 74 |
| 574 | AF000196 | *Caenorhabditis elegans* strong similarity to the SNF2/RAD54 family of helicases; partial CDS | 185 | 36 |
| 575 | L34587 | *Homo sapiens* RNA polymerase II elongation factor SIII, p15 subunit | 426 | 100 |
| 576 | AL035419 | *Homo sapiens* dJ1100H13.4 (putative RhoGAP domain containing protein) | 212 | 35 |
| 577 | D83004 | *Homo sapiens* ubiquitin-conjugating enzyme E2 UbcH-ben | 385 | 100 |
| 578 | Y87271 | Human signal peptide containing protein HSPP-48 SEQ ID NO: 48. | 474 | 86 |
| 579 | U96626 | *Mus musculus* chondroadherin | 341 | 29 |
| 580 | Z85986 | *Homo sapiens* dJ108K11.3 (similar to yeast suppressor protein SRP40) | 1468 | 99 |
| 581 | AF061529 | *Mus musculus* rjs | 230 | 32 |
| 582 | AF228738 | *Homo sapiens* profilin IIa | 750 | 100 |
| 583 | AF228738 | *Homo sapiens* profilin IIa | 624 | 87 |
| 584 | AF181640 | *Drosophila melanogaster* BcDNA.GH09817 | 190 | 47 |
| 585 | AB037901 | *Homo sapiens* gene amplified in squamous cell carcinoma-1 | 1340 | 54 |
| 586 | AF149285 | *Caenorhabditis elegans* Osm-3 | 806 | 62 |
| 587 | AF056021 | *Xenopus laevis* p80 katanin | 146 | 31 |
| 588 | U80931 | *Caenorhabditis elegans* strong similarity to class-III of pyridoxal-phoshate-dependent aminotransferases | 866 | 49 |
| 589 | AK026962 | *Homo sapiens* unnamed protein product | 1725 | 99 |
| 590 | AB011483 | *Arabidopsis thaliana* | 288 | 28 |
| 591 | AF152243 | *Mus musculus* putative E1-E2 ATPase | 3942 | 98 |
| 592 | AJ243460 | *Leishmania major* proteophosphoglycan | 204 | 25 |
| 593 | AX021519 | *Homo sapiens* unnamed protein product | 1317 | 99 |
| 594 | AL121581 | *Homo sapiens* dJ1022E24.4 (A novel protein weakly similar to protein-L-isoaspartate o-methyltransferase (EC 2.1.1.77)) | 1162 | 69 |
| 595 | AL031177 | *Homo sapiens* dJ889M15.3 (novel protein) | 177 | 44 |
| 596 | AL035601 | *Arabidopsis thaliana* putative protein | 301 | 28 |
| 597 | AF202118 | *Homo sapiens* HOX D1 protein | 1726 | 100 |
| 598 | AC007228 | *Homo sapiens* BC37295_1 | 955 | 42 |
| 599 | Z69727 | *Schizosaccharomyces pombe* probable ribosomal protein | 249 | 34 |
| 600 | L08134 | *Rattus norvegicus* glycoprotein | 278 | 24 |
| 601 | AK025598 | *Homo sapiens* unnamed protein product | 3738 | 99 |
| 602 | X89453 | *Rattus norvegicus* DRPLA | 173 | 27 |
| 603 | AF137030 | *Homo sapiens* transmembrane protein 2 | 1285 | 57 |
| 604 | AL356014 | *Arabidopsis thaliana* putative protein | 436 | 44 |
| 605 | G03490 | Human secreted protein, SEQ ID NO: 7571. | 450 | 96 |
| 606 | AY007380 | *Homo sapiens* F-box protein FBX30 | 1211 | 100 |
| 607 | D38076 | *Homo sapiens* Ran-BP1 (Ran-binding protein 1) | 916 | 100 |
| 608 | U27837 | *Diphyllobothrium dendriticum* actin | 1033 | 50 |
| 609 | M25750 | *Oryctolagus cuniculus* sarcolumenin precursor | 2307 | 97 |
| 610 | AF180920 | *Homo sapiens* cyclin L ania-6a | 630 | 51 |
| 611 | AF168990 | *Homo sapiens* putative GTP-binding protein | 2742 | 99 |
| 612 | U77942 | *Homo sapiens* syntaxin 7 | 421 | 98 |
| 613 | U00046 | *Caenorhabditis elegans* similar to yeast heat shock protein STI1 | 362 | 27 |
| 614 | AB001928 | *Homo sapiens* cathepsin V | 226 | 100 |
| 615 | AB016687 | *Arabidopsis thaliana* SMC-like protein | 326 | 22 |
| 616 | AL163279 | *Homo sapiens* homolog to cAMP response element binding and beta transducin family proteins | 181 | 53 |
| 617 | AF176524 | *Mus musculus* F-box protein FBL10 | 525 | 50 |
| 618 | AF070656 | *Homo sapiens* HSPC002 | 731 | 86 |

TABLE 2-continued

| SEQ ID NO: | ACCESSION NUMBER | DESCRIPTION | SMITH-WATERMAN SCORE | % IDENTITY |
|---|---|---|---|---|
| 619 | Y00339 | *Homo sapiens* carbonic anhydrase II (AA 1-260) | 910 | 88 |
| 620 | M29913 | *Homo sapiens* eosinophil peroxidase | 3757 | 100 |
| 621 | AC006768 | *Caenorhabditis elegans* contains similarity to *Mycoplasma genitalium* glycerol-3-phospate dehydrogenase (SW: P47285) | 1216 | 54 |
| 622 | AB033595 | *Mus musculus* gasdermin | 369 | 31 |
| 623 | AF132449 | *Mus musculus* smoothelin small isoform S1 | 646 | 54 |
| 624 | AF247039 | porcine adenovirus 3 163R* | 141 | 31 |
| 625 | L43065 | *Saccharomyces cerevisiae* suppresses the respiratory deficiency of a yeast pet mutant | 403 | 36 |
| 626 | AF071172 | *Homo sapiens* HERC2 | 483 | 35 |
| 627 | Y40090 | Peptide sequence derived from a human secreted protein. | 921 | 98 |
| 628 | AP001306 | *Arabidopsis thaliana* contains similarity to cell wall-plasma membrane linker protein-gene_id: MKA23.5 | 717 | 36 |
| 629 | AE004543 | *Pseudomonas aeruginosa* probable MFS transporter | 207 | 32 |
| 630 | AK025204 | *Homo sapiens* unnamed protein product | 1925 | 99 |
| 631 | AL050321 | *Homo sapiens* dJ717M23.1 (novel gene) | 2443 | 98 |
| 632 | AL050321 | *Homo sapiens* dJ717M23.1 (novel gene) | 3988 | 99 |
| 634 | U87804 | *Caulobacter crescentus* GidA | 396 | 65 |
| 635 | AF004161 | *Oryctolagus cuniculus* peroxisomal Ca-dependent solute carrier | 154 | 52 |
| 636 | U78090 | *Rattus norvegicus* potassium channel regulator 1 | 682 | 91 |
| 637 | AC002394 | *Homo sapiens* Gene product with similarity to dynein beta subunit | 536 | 41 |
| 638 | AL109640 | *Homo sapiens* dJ543J19.5 (CGI-107 Protein) | 478 | 98 |
| 639 | AB017065 | *Arabidopsis thaliana* contains similarity to small nuclear ribonucleoprotein-gene id: MFC16.18 | 125 | 34 |
| 640 | AK024498 | *Homo sapiens* FLJ00106 protein | 927 | 99 |
| 641 | AF187064 | *Homo sapiens* p75NTR-associated cell death executor; NADE | 303 | 57 |
| 642 | AB017507 | *Homo sapiens* Apg12 | 724 | 100 |
| 643 | AF035632 | *Rattus norvegicus* syntaxin 12 | 1231 | 90 |
| 644 | U48852 | *Cricetulus griseus* HT protein | 974 | 57 |
| 645 | AB015798 | *Homo sapiens* DnaJ homolog | 1572 | 93 |
| 646 | AB031046 | *Homo sapiens* HMG-box transcription factor TCF-3 | 3096 | 100 |
| 647 | U78547 | *Chlamydomonas reinhardtii* PF20 | 209 | 38 |
| 648 | AK024452 | *Homo sapiens* FLJ00044 protein | 2019 | 63 |
| 649 | Y13117 | Human secreted protein encoded by 5' EST SEQ ID NO: 131. | 268 | 100 |
| 650 | AB023419 | *Mus musculus* mSox7 | 1803 | 87 |
| 651 | AF176688 | *Rattus norvegicus* sodium/calcium/potassium exchanger NCKX1 | 184 | 34 |
| 652 | AK026622 | *Homo sapiens* unnamed protein product | 4385 | 99 |
| 653 | AFC16712 | *Mus musculus* testicular condensing enzyme | 191 | 36 |
| 654 | AF135440 | *Mus musculus* huntington yeast partner C | 4306 | 94 |
| 655 | AF135440 | *Mus musculus* huntington yeast partner C | 3709 | 86 |
| 656 | AK022184 | *Homo sapiens* unnamed protein product | 680 | 100 |
| 657 | U02467 | *Lilium longiflorum* meiotin-1 | 182 | 33 |
| 658 | M17099 | *Oryctolagus cuniculus* progesterone-induced protein | 1832 | 93 |
| 659 | AF113132 | *Homo sapiens* phosphoserine aminotransferase | 1673 | 100 |
| 660 | AF294790 | *Mus musculus* RING-finger protein MURF | 137 | 27 |
| 661 | X56203 | *Plasmodium falciparum* liver stage antigen | 157 | 22 |
| 662 | Y64994 | Human 5' EST related polypeptide SEQ ID NO: 1155. | 372 | 100 |
| 663 | U82626 | *Rattus norvegicus* basement membrane-associated chondroitin proteoglycan Bamacan | 146 | 22 |
| 664 | AF155739 | *Mus musculus* axotrophin | 3007 | 85 |
| 665 | AB037596 | *Mus musculus* beta-1,6-N-acetylglucosaminyltransferase B | 1257 | 73 |
| 666 | AF168132 | *Homo sapiens* RU1 | 2485 | 55 |
| 667 | AF132961 | *Homo sapiens* CGI-27 protein | 1197 | 100 |
| 668 | AB025258 | *Mus musculus* granuphilin | 729 | 42 |
| 669 | AL391688 | *Homo sapiens* bA524D16A.2.1 (novel protein similar to mouse granuphilin-a) | 762 | 43 |
| 670 | AP001745 | *Homo sapiens* human cDNA DKFZp586F0422, Accession No. AL050173 | 3747 | 100 |
| 671 | X58454 | *Homo sapiens* DS dopamine receptor | 1024 | 85 |
| 672 | AB017059 | *Arabidopsis thaliana* FH protein interacting protein FIP2 | 212 | 35 |
| 673 | AF255908 | *Streptococcus pneumoniae* PspA | 177 | 29 |
| 674 | Y02669 | Human secreted protein encoded by gene 20 clone HMKAH10. | 288 | 100 |
| 675 | AB024986 | *Oryza sativa* cyclin | 142 | 48 |
| 676 | X70681 | *Xenopus laevis* zinc finger protein | 144 | 33 |
| 677 | AL390026 | *Homo sapiens* dJ336K20B.1 (novel protein based on FGENESH) | 964 | 100 |
| 678 | AC026815 | *Oryza sativa* putative ATP-dependent RNA helicase (5'-partial) | 437 | 43 |
| 679 | AF196779 | *Homo sapiens* JM10 protein | 1182 | 98 |
| 680 | U40802 | *Caenorhabditis elegans* similar to other protein phosphatases 1, 2A and 2B | 325 | 36 |
| 681 | AJ238854 | *Rattus norvegicus* type A/B hnRNP p40 | 1659 | 91 |
| 682 | Y36083 | Extended human secreted protein sequence, SEQ. ID NO. 468. | 430 | 98 |
| 683 | U37283 | *Homo sapiens* microfibril-associated glycoprotein-2 MAGP-2 | 846 | 94 |
| 684 | AJ235270 | *Rickettsia prowazekii* 50S RIBOSOMAL PROTEIN L10 (rplJ) | 122 | 23 |
| 685 | W67828 | Human secreted protein encoded by gene 22 clone HFEAF41. | 510 | 100 |
| 686 | W67828 | Human secreted protein encoded by gene 22 clone HFEAF41. | 403 | 85 |
| 687 | AK026226 | *Homo sapiens* unnamed protein product | 1937 | 100 |
| 688 | AK026226 | *Homo sapiens* unnamed protein product | 578 | 100 |

TABLE 2-continued

| SEQ ID NO: | ACCESSION NUMBER | DESCRIPTION | SMITH-WATERMAN SCORE | % IDENTITY |
|---|---|---|---|---|
| 689 | D26549 | *Bos taurus* bovine adseverin | 3527 | 92 |
| 690 | AK024644 | *Homo sapiens* unnamed protein product | 245 | 67 |
| 691 | X63546 | *Homo sapiens* oncogene | 1083 | 78 |
| 692 | X63546 | *Homo sapiens* oncogene | 1613 | 83 |
| 693 | AB029334 | *Halocynthia roretzi* HrPET-1 | 614 | 37 |
| 694 | AF286473 | *Mus musculus* retinitis pigmentosa GTPase regulator | 181 | 35 |
| 695 | AB002405 | *Homo sapiens* LAK-4p | 346 | 34 |
| 696 | Y14448 | Human secreted protein encoded by gene 38 clone HFGAH44. | 316 | 100 |
| 697 | AL133216 | *Homo sapiens* bA291L22.2 (similar to CDC10 (cell division cycle 10, *S. cerevisiae*, homolog)) | 256 | 100 |
| 698 | AF065389 | *Homo sapiens* tetraspan NET-4 | 1111 | 74 |
| 699 | AF161390 | *Homo sapiens* HSPC272 | 281 | 81 |
| 700 | Z83114 | *Caenorhabditis elegans* K09B11.2 | 233 | 37 |
| 701 | Y41360 | Human secreted protein encoded by gene 53 clone H3PAD75. | 490 | 100 |
| 702 | Y41360 | Human secreted protein encoded by gene 53 clone HJPAD75. | 233 | 92 |
| 703 | AL049481 | *Arabidopsis thaliana* putative protein | 829 | 53 |
| 704 | U67949 | *Caenorhabditis elegans* contains similarity t to sugar and other transporters (Pfam: sugar_tr.hmm.score: 13.46) | 486 | 36 |
| 705 | J02883 | *Homo sapiens* colipase precursor | 243 | 100 |
| 706 | X66286 | *Gallus gallus* tensin | 1009 | 73 |
| 707 | G01118 | Human secreted protein, SEQ ID NO: 5199. | 360 | 100 |
| 708 | D50857 | *Homo sapiens* DOCK180 protein | 1060 | 51 |
| 709 | AE003511 | *Drosophila melanogaster* CG14194 gene product | 542 | 54 |
| 710 | L26247 | *Homo sapiens* isolog of yeast sui1 and rice gos2; putative | 470 | 86 |
| 711 | Y12952 | Amino acid sequence of a human secreted peptide. | 362 | 98 |
| 712 | U41849 | *Saccharomyces cerevisiae* Yta6p | 156 | 23 |
| 713 | AF168362 | *Rattus norvegicus* protein associating with small stress protein PASS1 | 220 | 35 |
| 714 | Y48256 | Human prostate cancer-associated protein 42. | 242 | 75 |
| 715 | AF053130 | *Mus musculus* unconventional myosin MYO15 | 579 | 36 |
| 716 | AF083385 | *Homo sapiens* 30 kDa splicing factor; SPF 30 | 133 | 40 |
| 717 | AF182417 | *Homo sapiens* MDS016 | 406 | 100 |
| 718 | AF065389 | *Homo sapiens* tetraspan NET-4 | 584 | 43 |
| 719 | W78132 | Human secreted protein encoded by gene 7 clone HPEBD85. | 246 | 100 |
| 720 | AK023971 | *Homo sapiens* unnamed protein product | 1358 | 100 |
| 721 | AF288813 | *Mus musculus* synembryn | 2384 | 86 |
| 722 | X56203 | *Plasmodium falciparum* liver stage antigen | 188 | 19 |
| 723 | AF190501 | *Homo sapiens* leucine-rich repeat-containing G protein-coupled receptor 6 | 4286 | 99 |
| 724 | AF022789 | *Homo sapiens* ubiquitin hydrolyzing enzyme I | 1689 | 88 |
| 725 | AF176531 | *Mus musculus* F-box protein FBX16 | 1412 | 80 |
| 726 | U10991 | *Homo sapiens* G2 | 756 | 30 |
| 727 | AE001795 | *Thermotoga maritima* glycerol kinase | 845 | 38 |
| 728 | AJ006692 | *Homo sapiens* ultra high sulfer keratin | 868 | 71 |
| 729 | Y76177 | Human secreted protein encoded by gene 54. | 866 | 99 |
| 730 | AL162295 | *Arabidopsis thaliana* guanine nucleotide exchange factor-like protein | 261 | 24 |
| 731 | AF016036 | *Drosophila tsacasi* repressor-like protein | 220 | 27 |
| 732 | Z54327 | *Caenorhabditis elegans* contains similarity to Pfam domain: PF00070 (pyridine nucleotide-disulphide oxidoreductase), Score = 82.7, E-value = 4e-24, N = 2 | 339 | 32 |
| 733 | AC011713 | *Arabidopsis thaliana* Contains similarity to gb\|AF092102 G-protein beta subunit git5p from *Schizosaccharomyces pombe* and contains 2 PF\|00400WD doinain, G-beta repeat domains. | 303 | 26 |
| 734 | AL109965 | *Homo sapiens* dJ1121G12.1.2 (A novel protein containing a putative PPD finger domain, isoform 2) | 323 | 60 |
| 735 | AB000910 | *Sus scrofa* ribosomal protein | 483 | 87 |
| 736 | Y07931 | Human secreted protein fragment encoded from gene 80. | 213 | 100 |
| 737 | M95718 | *Oryctolagus cuniculus* keratin | 233 | 65 |
| 738 | AL034382 | *Schizosaccharomyces pombe* putative Trp-Asp repeat protein | 453 | 35 |
| 739 | Y38401 | Human secreted protein encoded by gene No. 16. | 233 | 88 |
| 740 | U18917 | *Saccharomyces cerevisiae* Yer157wp | 338 | 26 |
| 741 | W64471 | Human secreted protein from clone DF989_3. | 545 | 97 |
| 742 | AJ000474 | *Homo sapiens* cytidine deaminase | 389 | 100 |
| 743 | AL132954 | *Arabidopsis thaliana* putative protein | 361 | 34 |
| 744 | AF026292 | *Homo sapiens* chaperonin containing t-complex polypeptide 1, eta subunit; CCT-eta | 890 | 100 |
| 745 | Y60251 | Human endometrium tumour EST encoded protein 311. | 392 | 98 |
| 746 | U07817 | *Dictyostelium discoideum* glutamine-asparagine rich protein | 148 | 30 |
| 747 | M58529 | *Homo sapiens* pro-alpha-2 type V collagen | 158 | 100 |
| 748 | AL118506 | *Homo sapiens* dJ591C20.5 (KIAA1196) | 952 | 45 |
| 749 | AF181645 | *Drosophila melanogaster* BcDNA.GH12144 | 105 | 54 |
| 750 | AF067136 | *Homo sapiens* protein phosphatase-1 regulatory subunit 7 alpha2 | 147 | 38 |
| 751 | AJ006973 | *Homo sapiens* TOM1 | 638 | 82 |
| 752 | AF145664 | *Drosophila melanogaster* BcDNA.GH11110 | 766 | 37 |
| 753 | Z70310 | *Caenorhabditis elegans* contains similarity to Pfam domain: PF00013 (KH domain), Score = 42.8, E-value = 3.7e-12, N = 1; PF00023 (Ank repeat), Score = 428.2, E-value = 2.4e-125, N = 19 | 510 | 34 |

TABLE 2-continued

| SEQ ID NO: | ACCESSION NUMBER | DESCRIPTION | SMITH-WATERMAN SCORE | % IDENTITY |
|---|---|---|---|---|
| 754 | AF276514 | *Mus musculus* 105-kDa kinase-like protein | 3769 | 88 |
| 755 | Y30734 | Amino acid sequence of a human secreted protein. | 258 | 96 |
| 756 | AF102129 | *Rattus norvegicus* KPL2 | 1436 | 79 |
| 757 | L15313 | *Caenorhabditis elegans* putative | 829 | 58 |
| 758 | AE003584 | *Drosophila melanogaster* CG7289 gene product | 529 | 34 |
| 759 | Y66693 | Membrane-bound protein PRO1004. | 569 | 92 |
| 760 | AC007766 | *Homo sapiens* R26610_1 | 1574 | 80 |
| 761 | AF073958 | *Homo sapiens* cytokine-inducible SH2 protein 6 | 1142 | 54 |
| 762 | Z71181 | *Caenorhabditis elegans* contains similarity to Pfam domain: PF00561 (alpha/beta hydrolase fold) Score = 83.7, E-value = 1.2e-21, N = 1 | 498 | 34 |
| 763 | AC005724 | *Arabidopsis thaliana* putative C3HC4-type RING zinc finger protein | 166 | 45 |
| 764 | AF052433 | *Strongylocentrotus purpuratus* katanin p80 subunit | 170 | 30 |
| 765 | X56044 | *Mus musculus* protein Htf9C | 759 | 44 |
| 766 | U56418 | *Homo sapiens* lysophosphatidic acid acyltransferase-beta | 834 | 100 |
| 767 | AK024388 | *Homo sapiens* unnamed protein product | 675 | 100 |
| 768 | W67828 | Human secreted protein encoded by gene 22 clone HFEAF41. | 278 | 100 |
| 769 | AF055993 | *Homo sapiens* mSin3A associated polypeptide p30 | 637 | 71 |
| 770 | AK024512 | *Homo sapiens* unnamed protein product | 454 | 93 |
| 771 | AF095844 | *Homo sapiens* melanoma differentiation associated protein-5 | 687 | 40 |
| 772 | AF169257 | *Homo sapiens* sodium/calcium exchanger NCKX3 | 3084 | 99 |
| 773 | D00824 | *Gallus gallus* alpha 1 chain of type XII collagen | 302 | 30 |
| 774 | X82557 | *Rattus norvegicus* myelin and lymphocyte protein | 257 | 39 |
| 775 | G03200 | Human secreted protein, SEQ ID NO: 7281. | 548 | 98 |
| 776 | AK024793 | *Homo sapiens* unnamed protein product | 1730 | 100 |
| 777 | AB019397 | *Homo sapiens* DNA topoisomerase II binding protein | 108 | 23 |
| 778 | AK025033 | *Homo sapiens* unnamed protein product | 817 | 99 |
| 779 | AB028069 | *Homo sapiens* activator of S phase Kinase | 474 | 36 |
| 780 | AF273052 | *Homo sapiens* CTCL tumor antigen se70-2 | 1294 | 100 |
| 781 | AF217512 | *Homo sapiens* uncharacterized bone marrow protein BM036 | 130 | 100 |
| 782 | AF121857 | *Homo sapiens* sorting nexin 7 | 2019 | 100 |
| 783 | AF305941 | *Homo sapiens* LIM2 | 933 | 100 |
| 784 | AF153085 | *Homo sapiens* phosphoprotein pp75 | 178 | 31 |
| 785 | AF106584 | *Caenorhabditis elegans* contains similarity to homeobox domains (Pfam: PF00046, score = 16.2, E = 0.015, N = 1) | 255 | 32 |
| 786 | AF106584 | *Caenorhabditis elegans* contains similarity to homeobox domains (Pfam: PF00046, score = 16.2, E = 0.015, N = 1) | 244 | 31 |
| 787 | AJ278508 | *Mus musculus* MDM2 binding protein | 567 | 76 |
| 788 | Z21507 | *Homo sapiens* human elongation factor-1-delta | 269 | 96 |
| 789 | AF096286 | *Mus musculus* pecanex 1 | 1498 | 52 |
| 790 | AC004882 | *Homo sapiens* similar to calmodulin; similar to P24044 (PID: g115520) | 525 | 60 |
| 791 | AJ133500 | *Xenopus laevis* p33 ringo | 547 | 49 |
| 792 | U41264 | *Caenorhabditis elegans* coded for by C. elegans CDNA cm13gl; Similar to bumetanide-sensitive Na—K—Cl cotransporter | 212 | 50 |
| 793 | X16078 | *Torpedo californica* 4-acetamido-4'-isothiocyanostilbene-2,2'-disulphonic acid-binding protein | 423 | 38 |
| 794 | AK026447 | *Homo sapiens* unnamed protein product | 833 | 100 |
| 795 | AL035417 | *Homo sapiens* dJ891H21.1 (HYPOTHETICAL 43.1 KD PROTEIN) | 465 | 100 |
| 796 | M83751 | *Homo sapiens* arginine-rich protein | 525 | 62 |
| 797 | AB037834 | *Homo sapiens* KIAA1413 protein | 7273 | 99 |
| 798 | AB037834 | *Homo sapiens* KIAA1413 protein | 6449 | 98 |
| 799 | AC011717 | *Arabidopsis thaliana* putative carnitine/acylcarnitine translocase; 50581–51656 | 450 | 37 |
| 800 | AC069143 | *Arabidopsis thaliana* Contains similarity to a transposable element Tip100 protein for transposase from *Ipomoea purpurea* gb|4063769 and is a member of the transmembrane 4 family PF|00335. | 305 | 25 |
| 801 | AY008372 | *Homo sapiens* oxysterol binding protein-related protein 3 | 4671 | 100 |
| 802 | AC004557 | *Arabidopsis thaliana* F17L21.20 | 404 | 39 |
| 803 | AF182218 | *Homo sapiens* epidermal lipoxygenase | 3830 | 99 |
| 804 | U90353 | *Strongyloides stercoralis* IgG and IgE immunreactive antigen recognized by sera from patients with strongyloidiasis | 108 | 35 |
| 805 | D13989 | *Homo sapiens* human rho GDI | 818 | 99 |
| 806 | U00482 | *Homo sapiens* gamma-subunit of rod cGMP-phosphodiesterase | 472 | 100 |
| 807 | Y19599 | SEQ ID NO 317 from WO9922243. | 590 | 98 |
| 808 | D50617 | *Saccharomyces cerevisiae* YFL042C | 227 | 31 |
| 809 | X58430 | *Homo sapiens* homeobox protein | 478 | 100 |
| 810 | M98539 | *Homo sapiens* prostaglandin D2 synthase | 464 | 97 |
| 811 | AJ004872 | *Homo sapiens* TCR beta chain | 1296 | 92 |
| 812 | G00329 | Human secreted protein, SEQ ID NO: 4410. | 524 | 100 |
| 813 | AL031431 | *Homo sapiens* dJ462O23.2 (novel protein) | 824 | 45 |
| 814 | M37760 | *Mus musculus* serine 2 ultra high sulfur protein | 633 | 55 |
| 815 | AL121673 | *Homo sapiens* bA305P22.2 (novel protein) | 2396 | 100 |
| 816 | AB027568 | *Mus musculus* thiamin pyrophosphokinase | 664 | 91 |

TABLE 2-continued

| SEQ ID NO: | ACCESSION NUMBER | DESCRIPTION | SMITH-WATERMAN SCORE | % IDENTITY |
|---|---|---|---|---|
| 817 | M37190 | *Homo sapiens* ras inhibitor | 792 | 40 |
| 818 | AL109659 | *Homo sapiens* dJ1024N4.1 (novel Sodium:solute symporter family member similar to SLC5A1 (SGLT1)) | 2858 | 100 |
| 819 | AB000170 | *Sus scrofa* endopeptidase 24.16 type M1 | 3472 | 94 |
| 820 | AF058789 | *Rattus norvegicus* SynGAP-a | 6651 | 99 |
| 821 | AK024408 | *Homo sapiens* unnamed protein product | 1040 | 100 |
| 822 | Y08260 | *Mus musculus* cytoplasmic polyadenylation element-binding protein (CPEB) | 2453 | 95 |
| 823 | Y36090 | Extended human secreted protein sequence, SEQ ID NO. 475. | 420 | 95 |
| 824 | AC003682 | *Homo sapiens* R28530_2 | 1398 | 48 |
| 825 | D89052 | *Homo sapiens* proton-ATPase-like protein | 356 | 100 |
| 826 | AB039903 | *Homo sapiens* interferon-responsive finger protein 1 long form | 978 | 61 |
| 827 | U96963 | *Mus musculus* p140mDia | 471 | 26 |
| 828 | AJ251641 | *Mus musculus* syncoilin | 656 | 89 |
| 829 | Z98595 | *Schizosaccharomyces pombe* coronin-like protein | 196 | 24 |
| 830 | AF116660 | *Homo sapiens* PRO1430 | 299 | 100 |
| 831 | AJ277442 | *Homo sapiens* xylosyltransferase II | 4625 | 100 |
| 832 | D86081 | *Mus musculus* S-II-T1 | 290 | 36 |
| 833 | L21671 | *Mus musculus* Eps8 | 547 | 31 |
| 834 | Z34801 | *Caenorhabditis elegans* Similarity with drosphila MSP-300 protein (PIR acc. no. S30431), contains similarity to Pfam domain: PF01465 (GRIP domain), Score = 90.2, E-value = 1.4e-23, N = 1 | 283 | 25 |
| 835 | AF264750 | *Homo sapiens* ALR-like protein | 21361 | 100 |
| 836 | AF176814 | *Mus musculus* Ab1-philin 2 | 247 | 41 |
| 837 | AL121771 | *Homo sapiens* dJ548G19.1.2 (novel protein (ortholog of mouse zinc finger protein ZFP64) (translation of cDNA NT2RP4001938 (Em: AK001744)) (isoform 2)) | 166 | 24 |
| 838 | G00405 | Human secreted protein, SEQ ID NO: 4486. | 397 | 98 |
| 839 | AF130357 | *Mus musculus domesticus* similar to RNA binding protein | 222 | 53 |
| 840 | AJ272034 | *Homo sapiens* putative capacitative calcium channel | 4470 | 100 |
| 841 | G02337 | Human secreted protein, SEQ ID NO: 6418. | 377 | 98 |
| 842 | AF286475 | *Takifugu rubripes* retinitis pigmentosa GTPase regulator-like protein | 226 | 22 |
| 843 | AB030183 | *Mus musculus* contains transmembrane (TM) region | 1159 | 89 |
| 844 | Y18890 | Human endogenous retrovirus K gag protein | 273 | 47 |
| 845 | AC004890 | *Homo sapiens* similar to HUB1; similar to BAA24380 (PID: g2789430) | 435 | 79 |
| 846 | Y66666 | Membrane-bound protein PRO1013. | 1858 | 99 |
| 847 | Y66666 | Membrane-bound protein PRO1013. | 1658 | 93 |
| 848 | AF119913 | *Homo sapiens* PRO3077 | 620 | 100 |
| 849 | Y36233 | Human secreted protein encoded by gene 10. | 302 | 96 |
| 850 | D14530 | *Homo sapiens* ribosomal protein | 341 | 100 |
| 851 | AC011713 | *Arabidopsis thaliana* Is a member of the PP|01553 Acyltransferase family. | 162 | 39 |
| 852 | Y36154 | Human secreted protein #26. | 296 | 98 |
| 853 | AC004877 | *Homo sapiens* zinc finger-like; similar to P52742 (PID: g1731411) | 2830 | 100 |
| 854 | M34163 | *Mus musculus* low affinity IgE receptor (FC-epsilon-RII) | 293 | 29 |
| 855 | X73579 | *Rattus norvegicus* CD23 | 333 | 31 |
| 856 | M34427 | *Homo sapiens* T-plastin | 414 | 98 |
| 857 | Y19456 | Amino acid sequence of a human secreted protein. | 307 | 90 |
| 858 | AF067136 | *Homo sapiens* protein phosphatase-1 regulatory subunit 7 beta1 | 199 | 47 |
| 859 | AC023279 | *Arabidopsis thaliana* F12K21.21 | 441 | 38 |
| 860 | G04069 | Human secreted protein, SEQ ID NO: 8150. | 491 | 100 |
| 861 | AP001297 | *Arabidopsis thaliana* gene_id:F14O13.28~ | 488 | 28 |
| 862 | Y19587 | Amino acid sequence of a human secreted protein. | 160 | 96 |
| 863 | AB039861 | *Schizosaccharomyces pombe* Eso1 | 201 | 31 |
| 864 | U34932 | *Rattus norvegicus* Fos-related antigen | 2062 | 84 |
| 865 | Y60152 | Human endometrium tumour EST encoded protein 212. | 379 | 100 |
| 866 | AK027028 | *Homo sapiens* unnamed protein product | 2294 | 99 |
| 867 | AF039718 | *Caenorhabditis elegans* contains similarity to lupus LA protein homologs | 329 | 44 |
| 868 | AK024480 | *Homo sapiens* FLJ00074 protein | 1001 | 100 |
| 869 | AF320909 | *Homo sapiens* MAGE-E1 | 634 | 100 |
| 870 | AF126484 | *Homo sapiens* CARD4 | 181 | 30 |
| 871 | Z83844 | *Homo sapiens* dJ37E16.5 (novel protein similar to nitrophenylphosphatases from various organisms) | 651 | 46 |
| 872 | AF128406 | *Homo sapiens* nuclear prelamin A recognition factor | 1121 | 47 |
| 873 | Y16790 | *Homo sapiens* keratin type I | 2029 | 99 |
| 874 | AJ006692 | *Homo sapiens* ultra high sulfer keratin | 1073 | 88 |
| 875 | U43281 | *Saccharomyces cerevisiae* Lpg21p | 323 | 40 |
| 876 | AF078844 | *Homo sapiens* hqp0376 protein | 362 | 81 |
| 877 | AB025258 | *Mus musculus* granuphilin-a | 3193 | 90 |
| 878 | D37991 | *Homo sapiens* beta-signal sequence receptor | 847 | 99 |
| 879 | AL035427 | *Homo sapiens* dJ769N13.1 (KIAA0443 protein.) | 510 | 28 |
| 880 | AL109925 | *Homo sapiens* dJ534K7.2 (novel protein) | 3323 | 100 |
| 881 | AF254411 | *Homo sapiens* ser/arg-rich pre-mRNA splicing factor SR-A1 | 6833 | 100 |
| 882 | AL137082 | *Arabidopsis thaliana* putative protein | 310 | 42 |
| 883 | M97188 | *Strongylocentrotus purpuratus* tektin A1 | 292 | 40 |
| 884 | Y10837 | Amino acid sequence of a human secreted protein. | 434 | 100 |

TABLE 2-continued

| SEQ ID NO: | ACCESSION NUMBER | DESCRIPTION | SMITH-WATERMAN SCORE | % IDENTITY |
|---|---|---|---|---|
| 885 | Z12172 | *Homo sapiens* putative homeotic protein | 1388 | 79 |
| 886 | AJ000479 | *Homo sapiens* putative G-Protein coupled receptor, EDG6 | 177 | 30 |
| 887 | X56044 | *Mus musculus* protein Htf9C | 2360 | 75 |
| 888 | AC006963 | *Homo sapiens* similar to Kelch proteins; similar to BAA77027 (PID: g4650844) | 268 | 27 |
| 889 | AF205357 | *Drosophila melanogaster* extracellular matrix protein papilin | 503 | 33 |
| 890 | AB027757 | *Cicer arietinum* NADPH oxidoreductase homolog | 719 | 45 |
| 891 | AL022140 | *Arabidopsis thaliana* serine/threonine protein kinase like protein | 153 | 30 |
| 892 | AF286473 | *Mus musculus* retinitis pigmentosa GTPase regulator | 208 | 28 |
| 893 | AL050328 | *Homo sapiens* bA145L22.2 (novel KRAB box containing C2H2 type zinc finger protein) | 2072 | 99 |
| 894 | AL096856 | *Arabidopsis thaliana* putative protein | 223 | 44 |
| 895 | AF245517 | *Homo sapiens* vacuolar proton pump 116 kDa accessory subunit | 4378 | 100 |
| 896 | AB000113 | *Rattus norvegicus* cationic amino acid transporter 3 | 2644 | 83 |
| 897 | AF142406 | *Babesia bigemina* 200 kDa antigen p200 | 588 | 24 |
| 898 | AF062476 | *Mus musculus* retinoic acid-responsive protein; STRA6 | 2184 | 75 |
| 899 | Y48507 | Human breast tumour-associated protein 52. | 308 | 98 |
| 900 | U79745 | *Homo sapiens* monocarboxylate transporter homologue MCT6 | 465 | 46 |
| 901 | AF145661 | *Drosophila melanogaster* BcDNA.GH10646 | 376 | 24 |
| 902 | AC009519 | *Arabidopsis thaliana* F1N19.17 | 241 | 29 |
| 903 | Y27576 | Human secreted protein encoded by gene No. 10. | 394 | 96 |
| 904 | AF192968 | *Homo sapiens* high-glucose-regulated protein 8 | 2041 | 67 |
| 905 | AP001743 | *Homo sapiens* putative gene, ankirin like, possible dual specifity Ser/Thr/Tyr kinase domain | 4306 | 99 |
| 906 | U71205 | *Mus musculus* rit | 252 | 35 |
| 907 | M77003 | *Mus musculus* glycerol-3-phosphate acyltransferase | 3366 | 93 |
| 908 | AF286368 | *Homo sapiens* eppin-1 | 222 | 54 |
| 909 | AC006439 | *Arabidopsis thaliana* putative ADP-ribosylation factor | 261 | 34 |
| 910 | AF230808 | *Homo sapiens* zinc finger transcription factor Pegasus | 2279 | 99 |
| 911 | AF134804 | *Mus musculus* putative zinc finger transcription factor OVO1 | 698 | 52 |
| 912 | AF049907 | *Homo sapiens* zinc finger transcription factor | 530 | 31 |
| 913 | AF217319 | *Mus musculus* putative repair and recominbination helicase RAD26L | 3218 | 89 |
| 914 | X80473 | *Mus musculus* rab19 | 1008 | 88 |
| 915 | U88315 | *Caenorhabditis elegans* weak similarity to Plasmodium vivax reticulocyte-binding protein 2 (GI: 160628) | 609 | 36 |
| 916 | AF273052 | *Homo sapiens* CTCL tumor antigen se70-2 | 1237 | 99 |
| 917 | U34932 | *Rattus norvegicus* Fos-related antigen | 2258 | 84 |
| 918 | AF116911 | *Mus musculus* thymic dendritic cell-derived factor 1 | 305 | 92 |
| 919 | AF205935 | *Mus musculus* MGA protein | 4822 | 84 |
| 920 | AL157413 | *Homo sapiens* bA526K17.1 (novel protein). | 1076 | 100 |
| 921 | Y10823 | Amino acid sequence of a human secreted protein. | 183 | 100 |
| 922 | Z97653 | *Homo sapiens* c380A1.1b (novel protein) | 1106 | 100 |
| 923 | Z24725 | *Homo sapiens* mitogen inducible gene mig-2 | 1461 | 56 |
| 924 | AF113917 | *Homo sapiens* NADP+-dependent isocitrate dehydrogenase | 1428 | 100 |
| 925 | AF064604 | *Homo sapiens* KE03 protein | 1025 | 57 |
| 926 | AF064604 | *Homo sapiens* KE03 protein | 972 | 58 |
| 927 | AL033545 | *Arabidopsis thaliana* putative protein | 84 | 35 |
| 928 | AJ007014 | *Homo sapiens* AMMECR1 protein | 733 | 64 |
| 929 | AJ276316 | *Homo sapiens* zinc finger protein 304 | 1007 | 51 |
| 930 | AC004077 | *Arabidopsis thaliana* putative katanin | 877 | 57 |
| 931 | D16226 | *Oryctolagus cuniculus* one of the members of sodium-glucose cotransporter family | 2008 | 71 |
| 932 | D16226 | *Oryctolagus cuniculus* one of the members of sodium-glucose cotransporter family | 3026 | 83 |
| 933 | AF234676 | *Sus scrofa* adipose differentiation-related protein | 336 | 29 |
| 934 | U70732 | *Homo sapiens* glutamate pyruvate transaminase | 1821 | 68 |
| 935 | AB027004 | *Homo sapiens* protein phosphatase | 462 | 48 |
| 936 | AF043180 | *Homo sapiens* T cell receptor beta chain | 1097 | 69 |
| 937 | AC006528 | *Arabidopsis thaliana* putative DNA replication licensing factor | 742 | 41 |
| 938 | L08483 | *Drosophila melanogaster* ring canal protein | 660 | 31 |
| 939 | AL022238 | *Homo sapiens* dJ1042K10.4 (novel protein) | 758 | 46 |
| 940 | AF275151 | *Rattus norvegicus* androgen receptor-related apoptosis-associated protein CBL27 | 619 | 55 |
| 941 | AF275151 | *Rattus norvegicus* androgen receptor-related apoptosis-associated protein CBL27 | 619 | 55 |
| 942 | AE000854 | *Methanothermobacter thermoautotrophicus* Na+/H+-exchanging protein: Na+/H+ antiporter | 498 | 35 |
| 943 | D88894 | *Homo sapiens* brain acyl-CoA hydrolase | 1742 | 100 |
| 944 | AP001072 | *Oryza sativa* Similar to *Arabidopsis thaliana* DNA chromosome 4, BAC clone F22K18, putative protein. (AL035356) | 248 | 33 |
| 945 | AB033744 | *Mus musculus* type II cytokeratin | 835 | 74 |
| 946 | AP186461 | *Rattus norvegicus* ring finger protein Fxy | 351 | 30 |
| 947 | AK025539 | *Homo sapiens* unnamed protein product | 2555 | 99 |
| 948 | J03407 | *Homo sapiens* rfp transforming protein | 507 | 40 |

TABLE 3

| SEQ ID NO: | ACCESSION NO. | DESCRIPTION | RESULTS* |
|---|---|---|---|
| 2 | BL00972 | Ubiquitin carboxyl-terminal hydrolases family 2 proteins. | BL00972A 11.93 2.500e-20 267–285<br>BL00972D 22.55 5.179e-17 828–853<br>BL00972E 20.72 8.650e-13 855–877<br>BL00972C 16.48 7.120e-11 411–426<br>BL00972B 9.45 7.923e-10 353–363 |
| 3 | BL00018 | EF-hand calcium-binding domain proteins. | BL00018 7.41 5.696e-09 331–344 |
| 4 | BL00018 | EF-hand calcium-binding domain proteins. | BL00018 7.41 5.696e-09 331–344 |
| 5 | PR00401 | SH2 DOMAIN SIGNATURE | PR00401B 12.94 1.000e-08 340–351 |
| 6 | PR00401 | SH2 DOMAIN SIGNATURE | PR00401B 12.94 1.000e-08 367–378 |
| 7 | BL00625 | Regulator of chromosome condensation (RCC1) proteins. | BL00625A 16.21 7.787e-16 308–337<br>BL00625A 16.21 7.369e-15 190–219<br>BL00625B 17.69 1.514e-13 302–336<br>BL00625B 17.69 2.286e-13 184–218<br>BL00625B 17.69 3.957e-13 132–166<br>BL00625A 16.21 5.690e-13 138–167<br>BL00625A 16.21 5.731e-11 360–389<br>BL00625B 17.69 3.333e-10 354–388 |
| 9 | BL00120 | Lipases, serine proteins. | BL00120B 11.37 9.486e-12 166–181 |
| 15 | BL00183 | Ubiquitin-conjugating enzymes proteins. | BL00183 28.97 1.329e-10 45–93 |
| 18 | PR00049 | WILM'S TUMOUR PROTEIN SIGNATURE | PR00049D 0.00 6.034e-09 262–277 |
| 19 | PR00049 | WILM'S TUMOUR PROTEIN SIGNATURE | PR00049D 0.00 6.034e-09 74–89 |
| 20 | BL00790 | Receptor tyrosine kinase class V proteins. | BL00790D 12.41 8.297e-09 804–829 |
| 21 | BL00790 | Receptor tyrosine kinase class V proteins. | BL00790D 12.41 8.297e-09 878–903 |
| 23 | PR00380 | KINESIN HEAVY CHAIN SIGNATURE | PR00380D 9.93 2.080e-22 321–343<br>PR00380A 14.18 1.486e-21 79–101<br>PR00380B 12.64 6.571e-18 217–235<br>PR00380C 13.18 6.927e-13 269–288 |
| 25 | BL01242 | Formamidopyrimidine-DNA glycosylase proteins. | BL01242F 17.92 5.300e-11 32–66 |
| 27 | PF00651 | BTB (also known as BR-C/Ttk) domain proteins. | PF00651 15.00 2.500e-14 46–59 |
| 28 | DM00215 | PROLINE-RICH PROTEIN 3. | DM00215 19.43 3.898e-09 99–132 |
| 29 | PR00380 | KINESIN HEAVY CHAIN SIGNATURE | PR00380A 14.18 9.250e-25 93–115<br>PR00380D 9.93 4.857e-19 302–324<br>PR00380B 12.64 4.429e-18 212–230<br>PR00380C 13.18 1.692e-16 247–266 |
| 30 | BL00107 | Protein kinases ATP-binding region proteins. | BL00107A 18.39 3.368e-18 36–67 |
| 32 | BL00594 | Aromatic amino acids permeases proteins. | BL00594A 16.75 9.376e-09 76–120 |
| 34 | BL00790 | Receptor tyrosine kinase class V proteins. | BL00790E 29.58 1.111e-12 614–662<br>BL00790E 29.58 3.111e-12 668–716<br>BL00790E 29.58 7.000e-10 560–608 |
| 38 | BL00290 | Immunoglobulins and major histocompatibility complex proteins. | BL00290A 20.89 4.150e-12 126–149 |
| 39 | PR00019 | LEUCINE-RICH REPEAT SIGNATURE | PR00019A 11.19 6.087e-10 93–107<br>PR00019B 11.36 7.840e-09 90–104 |
| 42 | PD01443 | INHIBITOR CALPAIN CALPASTATIN REPEAT THIOL PROT. | PD01443D 8.36 4.670e-09 815–837 |
| 43 | BL01101 | Casein kinase II regulatory subunit proteins. | BL01101A 16.07 1.000e-40 9–54<br>BL01101B 10.94 9.000e-31 72–97 |
| 46 | BL01166 | RNA polymerases beta chain proteins. | BL01166G 18.10 2.500e-34 824–866<br>BL01166H 19.05 9.410e-30 936–986<br>BL01166D 17.37 4.396e-19 612–642<br>BL01166E 13.47 8.244e-17 682–706<br>BL01166C 12.21 9.357e-12 431–456 |
| 47 | BL00518 | Zinc finger, C3HC4 type (RING finger), proteins. | BL00518 12.23 7.000e-09 25–34 |
| 48 | BL00038 | Myc-type, 'helix-loop-helix' dimerization domain proteins. | BL00038A 13.61 6.625e-11 284–300 |
| 49 | BL00905 | GTP1/OBG family proteins. | BL00905D 15.00 4.214e-10 125–140 |
| 50 | BL00107 | Protein kinases ATP-binding region proteins. | BL00107B 13.31 7.300e-15 64–80 |
| 53 | BL00383 | Tyrosine specific protein phosphatases proteins. | BL00383E 10.35 5.263e-09 328–339 |
| 55 | BL00383 | Tyrosine specific protein phosphatases proteins. | BL00383E 10.35 5.263e-09 246–257 |

TABLE 3-continued

| SEQ ID NO: | ACCESSION NO. | DESCRIPTION | RESULTS* |
|---|---|---|---|
| 56 | BL00383 | Tyrosine specific protein phosphatases proteins. | BL00383E 10.35 5.263e-09 328–339 |
| 62 | BL00226 | Intermediate filaments proteins. | BL00226B 23.86 5.919e-09 560–608 |
| 64 | PR00322 | G10 PROTETN | PR00322E 6.62 1.720e-10 30–40 |
| 65 | BL00269 | Mammalian defensins proteins. | BL00269C 16.52 6.786e-26 110–139 |
|  |  |  | BL00269A 8.53 2.607e-20 45–65 |
|  |  |  | BL00269B 19.17 5.500e-17 72–101 |
| 66 | BL01160 | Kinesin light chain repeat proteins. | BL01160B 19.54 8.297e-10 6–60 |
| 67 | BL00028 | Zinc finger, C2H2 type, domain proteins. | BL00028 16.07 5.846e-11 476–493 |
|  |  |  | BL00028 16.07 6.192e-11 989–1006 |
| 71 | BL00289 | Pentaxin family proteins. | BL00289E 18.00 4.375e-13 22–37 |
| 74 | BL00348 | p53 tumor antigen proteins. | BL00348F 23.19 4.571e-09 140–183 |
| 75 | BL00455 | Putative AMP-binding domain proteins. | BL00455 13.31 6.684e-13 248–264 |
| 78 | BL00421 | Transmembrane 4 family proteins. | BL00421E 20.97 1.851e-09 17–47 |
| 80 | PD01066 | PROTEIN ZINC FINGER ZINC-FINGER METAL-BINDINC NU. | PD01066 19.43 2.149e-29 6–45 |
| 81 | PR00014 | FIBRONECTIN TYPE III REPEAT SIGNATURE | PR00014D 12.04 2.059e-10 215–230 |
| 84 | BL00269 | Mammalian defensins proteins. | BL00269C 16.52 6.786e-26 133–162 |
|  |  |  | BL00269A 8.53 2.607e-20 68–88 |
|  |  |  | BL00269B 19.17 5.500e-17 95–124 |
| 85 | PD01876 | ANTIGEN MELANOMA-ASSOCIATED MULTIGENE FAMILY TUM. | PD01876C 21.73 1.231e-20 75–128 |
| 86 | PD02870 | RECEPTOR INTERLEUKIN-1 PRECURSOR. | PD02870B 18.83 8.835e-11 326–359 |
| 87 | PR00988 | URIDINE KINASE SIGNATURE | PR00988A 6.39 6.276e-12 386–376 |
| 90 | BL00120 | Lipases, serine proteins. | BL00120C 12.62 9.053e-12 95–106 |
| 96 | BL00027 | 'Homeobox' domain proteins. | BL00027 26.43 5.500e-30 169–212 |
| 100 | BL01128 | Shikimate kinase proteins. | BL01128A 18.84 8.200e-14 7–41 |
| 101 | PR00014 | FIBRONECTIN TYPE III REPEAT SIGNATURE | PR00014C 15.44 1.783e-09 211–230 |
|  |  |  | PR00014A 8.22 3.045e-09 373–383 |
|  |  |  | PR00014C 15.44 6.087e-09 309–328 |
| 102 | DM00372 | CARCINOEMBRYONIC ANTIGEN PRECURSOR AMINO-TERMINAL DOMAIN. | DM00372C 23.69 4.919e-12 67–103 |
| 105 | BL01282 | BIR repeat proteins. | BL01282B 30.49 1.000e-11 194–233 |
| 109 | PR00464 | E-CLASS P450 GROUP II SIGNATURE | PR00464A 20.47 9.591e-16 149–170 |
|  |  |  | PR00464C 18.84 1.000e-15 324–353 |
|  |  |  | PR00464D 17.40 6.250e-15 353–371 |
|  |  |  | PR00464B 20.41 1.844e-12 205–224 |
| 110 | PD02382 | RECEPTOR CHAIN PRECURSOR TRANSME. | PD02382A 17.43 9.321e-09 99–115 |
| 112 | BL00795 | Involucrin proteins. | BL00795C 17.06 6.442e-10 905–950 |
| 115 | DM00215 | PROLINE-RICH PROTEIN 3. | DM00215 19.43 6.644e-09 603–636 |
| 116 | BL01282 | BIR repeat proteins. | BL01282B 30.49 1.000e-11 137–176 |
| 117 | BL01282 | BIR repeat proteins. | BL01282B 30.49 1.000e-11 187–226 |
| 118 | BL00218 | Amino acid permeases proteins. | BL00218D 21.49 7.324e-11 226–271 |
|  |  |  | BL00218E 23.30 3.475e-09 307–347 |
| 119 | BL00994 | Bacterial export FHIPEP family proteins. | BL00994A 15.15 1.086e-09 71–118 |
| 120 | PD01066 | PROTEIN ZINC FINGER ZINC-FINGER METAL-BINDING NU. | PD01066 19.43 8.385e-33 6–45 |
| 121 | PD01427 | TRANSFERASE METHYLTRANSFERASE BI. | PD01427B 22.45 1.545e-11 117–158 |
| 122 | PF00168 | C2 domain proteins. | PR00168C 27.49 1.750e-09 202–228 |
| 127 | PR00962 | LETHAL(2) GIANT LARVAE PROTEIN SIGNATURE | PR00962D 10.40 3.054e-10 178–202 |
| 130 | DM01970 | 0 kw ZK632.12 YDR313C ENDOSOMAL III. | DM01970B 8.60 2.478e-13 310–323 |
| 131 | PF00774 | Dihydropyridine sensitive L-type calcium channel (Beta subuni. | PF00774D 10.59 8.396e-09 339–365 |
| 132 | BL00615 | C-type lectin domain proteins. | BL00615A 16.68 3.160e-11 129–147 |
| 133 | PD01066 | PROTEIN ZINC FINGER ZINC-FINGER METAL-BINDING NU. | PD01066 19.43 2.705e-11 47–86 |

TABLE 3-continued

| SEQ ID NO: | ACCESSION NO. | DESCRIPTION | RESULTS* |
|---|---|---|---|
| 134 | BL00359 | Ribosomal protein L11 proteins. | BL00359B 23.07 7.462e-24 160–201<br>BL00359C 22.18 6.586e-22 215–249<br>BL00359A 20.66 4.000e-21 124–160 |
| 136 | PD02462 | PROTEIN BOLA TRANSCRIPTION REGULATION AC. | PD02462A 22.48 1.220e-09 104–139 |
| 137 | PR00679 | PROHIBITIN SIGNATURE | PR00679F 8.03 6.478e-28 178–202<br>PR00679C 14.44 7.677e-22 107–126<br>PR00679E 12.82 5.171e-19 153–173<br>PR00679D 11.91 9.053e-18 130–147<br>PR00679G 6.13 7.882e-17 201–218<br>PR00679B 13.63 2.444e-10 84–104 |
| 138 | PR00245 | OLFACTORY RECEPTOR SIGNATURE | PR00245E 12.40 8.286e-12 45–60 |
| 139 | PD00126 | PROTEIN REPEAT DOMAIN TPR NUCLEA. | PD00126A 22.53 6.885e-10 99–120 |
| 140 | BL01145 | Ribosomal protein L34e proteins. | BL01145A 13.73 1.000e-12 3–45 |
| 145 | BL00154 | E1-E2 ATPases phosphorylation site proteins. | BL00154D 12.57 7.387e-09 95–106 |
| 147 | PD00066 | PROTEIN ZINC-FINGER METAL-BINDI. | PD00066 13.92 7.923e-15 439–452<br>PD00066 13.92 2.800e-14 411–424<br>PD00066 13.92 2.800e-14 467–480<br>PD00066 13.92 5.800e-14 495–508<br>PD00066 13.92 5.800e-14 523–536<br>PD00066 13.92 8.200e-14 355–368<br>PD00066 13.92 5.500e-13 579–592<br>PD00066 13.92 3.143e-12 551–564<br>PD00066 13.92 4.857e-12 383–396 |
| 149 | BL00649 | G-protein coupled receptors family 2 proteins. | BL00649C 17.82 9.542e-12 400–426 |
| 152 | BL00479 | Phorbol esters/diacylglycerol binding domain proteins. | BL00479B 12.57 8.875e-09 886–902 |
| 153 | PR00205 | CADHERIN SIGNATURE | PR00205B 11.39 5.655e-16 255–273<br>PR00205A 14.73 1.000e-12 180–196<br>PR00205B 11.39 4.927e-10 475–493<br>PR00205C 13.65 9.438e-10 515–530 |
| 155 | BL00122 | Carboxylesterases type-B serine proteins. | BL00122A 12.04 3.152e-15 86–107<br>BL00122D 12.53 7.097e-14 197–213<br>BL00122B 16.84 1.346e-13 148–159<br>BL00122C 7.91 9.550e-10 168–179 |
| 157 | BL00018 | EF–hand calcium-binding domain proteins. | BL00018 7.41 2.800e-10 217–230<br>BL00018 7.41 8.650e-10 133–146 |
| 160 | PD00066 | PROTEIN ZINC-FINGER METAL-BINDI. | PD00066 13.92 6.143e-12 927–940<br>PD00066 13.92 7.000e-09 343–356 |
| 161 | DM01857 | 5 kw NUCLEOSIDE TRANSPORT DEPENDENT NA. | DM01857B 14.94 6.471e-19 284–312<br>DM01B57E 18.90 7.313e-18 488–527<br>DM01857F 12.86 7.045e-15 548–575<br>DM01857C 15.62 4.500e-14 312–344<br>DM01857A 20.25 1.667e-13 207–250<br>DM01857D 16.80 3.165e-12 372–410 |
| 164 | DM01840 | kw SPAC24B11.09 R07E5.13. | DM01840B 22.04 1.844e-40 59–103<br>DM01840A 10.95 9.571e-13 31–43 |
| 166 | BL01115 | GTP-binding nuclear protein ran proteins. | BL01115A 10.22 3.438e-14 53–97 |
| 167 | PF00622 | Domain in SPla and the Ryanodine Receptor. | PF00622B 21.00 2.500e-13 265–287 |
| 168 | PR00019 | LEUCINE-RICH REPEAT SIGNATURE | PR00019A 11.19 5.050e-11 66–80<br>PR00019B 11.36 6.850e-10 63–77 |
| 169 | BL00509 | Ras GTPase-activating proteins. | BL00509B 10.28 5.263e-10 429–440 |
| 172 | PR00720 | MAMMALIAN LMW PHOSPHOTYROSINE PROTEIN PHOSPHATASE SIGNATURE | PR00720C 12.41 1.099e-27 88–109<br>PR00720B 10.61 4.789e-20 71–87<br>PR00720A 16.54 2.000e-17 28–41<br>PR00720E 10.01 1.342e-16 117–139<br>PR00720D 17.32 1.778e-15 110–127 |
| 173 | PD00131 | ATP-BINDING TRANSPORT TRANSMEMBR. | PD00131B 34.97 7.987e-09 108–162 |
| 175 | BL00615 | C-type lectin domain proteins. | BL00615A 16.68 9.526e-13 573–591 |
| 179 | BL00134 | Serine proteases, trypsin family, histidine proteins. | BL00134A 11.96 5.781e-15 493–510<br>BL00134B 15.99 4.194e-14 675–699 |
| 180 | BL00236 | Neurotransmitter-gated ion-channels proteins. | BL00236D 25.66 4.000e-30 64–106 |

TABLE 3-continued

| SEQ ID NO: | ACCESSION NO. | DESCRIPTION | RESULTS* |
|---|---|---|---|
| 181 | BL00604 | Synaptophysin/synaptoporin proteins. | BL00604F 5.96 7.718e-10 367–412 |
| 184 | PR00042 | FOS TRANSFORMING PROTEIN SIGNATURE | PR00042E 9.69 7.652e-09 234–258 |
| 187 | PD00066 | PROTEIN ZINC-FINGER METAL-BINDI. | PD00066 13.92 9.400e-14 365–378<br>PD00066 13.92 6.143e-12 335–348<br>PD00066 13.92 2.174e-11 395–408 |
| 188 | BL00962 | Ribosomal protein S2 proteins. | BL00962D 22.51 5.500e-35 131–175<br>BL00962C 15.90 9.591e-17 106–124<br>BL00962B 36.15 9.060e-15 40–94 |
| 189 | BL00152 | ATP synthase alpha and beta subunits proteins. | BL00152A 15.38 5.109e-14 128–154 |
| 191 | BL00152 | ATP synthase alpha and beta subunits proteins. | BL00152B 21.40 4.273e-37 124–162<br>BL00152A 15.38 8.364e-23 67–93 |
| 192 | BL00152 | ATP synthase alpha and beta subunits proteins. | BL00152B 21.40 2.000e-32 185–223<br>BL00152A 15.38 8.364e-23 128–154 |
| 193 | PR00493 | BREAST CANCER TYPE I SUSCEPTIBILITY PROTEIN SIGNATURE | PR00493G 7.57 1.184e-10 652–673 |
| 195 | BL00301 | GTP-binding elongation factors proteins. | BL00301A 12.41 1.750e-12 72–84 |
| 197 | BL00745 | Prokaryotic-type class I peptide chain release factors signat. | BL00745C 13.66 7.398e-18 59–106 |
| 198 | BL00745 | Prokaryotic-type class I peptide chain release factors signat. | BL00745C 13.66 4.706e-12 59–106 |
| 201 | BL00660 | Band 4.1 family domain proteins. | BL00660B 17.33 4.800e-27 136–176<br>BL00660A 31.50 7.911e-20 52–105<br>BL00660C 23.36 2.241e-19 215–259<br>BL00660E 23.41 9.647e-13 301–324 |
| 205 | PR00109 | TYROSINE KINASE CATALYTIC DOMAIN SIGNATURE | PR00109B 12.27 1.882e-12 155–174 |
| 207 | PR00837 | ALLERGEN V5/TPX-1 FAMILY SIGNATURE | PR00837C 17.21 4.064e-11 155–172<br>PR00837A 14.77 4.960e-10 78–97<br>PR00837B 11.64 1.310e-09 133–147 |
| 208 | BL01115 | GTP-binding nuclear protein ran proteins. | BL01115A 10.22 8.909e-13 4–48 |
| 211 | BL00175 | Phosphoglycerate mutase famiiy phosphohistidine proteins. | BL00175D 27.67 4.000e-40 367–419<br>BL00175C 23.75 6.870e-28 316–348<br>BL00175A 15.42 8.200e-19 252–272<br>BL00175B 12.60 8.714e-17 299–312 |
| 212 | PD00066 | PROTEIN ZINC-FINGER METAL-BINDI. | PD00066 13.92 1.000e-14 547–560<br>PD00066 13.92 2.200e-14 353–366<br>PD00066 13.92 3.400e-14 241–254<br>PD00066 13.92 6.400e-14 325–338<br>PD00066 13.92 1.500e-13 297–310<br>PD00066 13.92 6.500e-13 465–478<br>PD00066 13.92 7.500e-13 437–450<br>PD00066 13.92 8.500e-13 409–422<br>PD00066 13.92 2.714e-12 269–282<br>PD00066 13.92 3.571e-12 381–394<br>PD00066 13.92 7.577e-10 519–532 |
| 213 | PD02331 | CYCLIN CELL CYCLE DIVISION PROTE. | PD02331C 13.84 1.913e-11 9–36 |
| 215 | BL00239 | Receptor tyrosine kinase class II proteins. | BL00239B 25.15 3.915e-15 100–148 |
| 216 | BL01013 | Oxysterol-binding protein famiiy proteins. | BL01013D 26.81 9.135e-22 501–545<br>BL01013A 25.14 4.600e-14 220–256<br>BL01013C 9.97 4.906e-12 330–340<br>BL01013B 11.33 3.017e-11 287–298 |
| 219 | BL00289 | Pentaxin family protiens. | BL00289A 30.36 6.850e-26 25–56<br>BL00289E 18.00 6.684e-14 78–93 |
| 220 | PR00217 | 43 KD POSTSYNAPTIC PROTEIN SIGNATRRE | PR00217C 10.91 7.527e-09 547–563 |
| 221 | PR00756 | MEMBRANE ALANYL DIPEPTIDASE (M1) FAMILY SIGNATURE | PR00756D 10.58 1.529e-21 367–383<br>PR00756B 14.06 5.737e-16 253–269<br>PR00756A 12.90 1.237e-13 205–221<br>PR00756E 11.91 4.094e-13 386–399<br>PR00756C 11.60 6.108e-11 331–342 |
| 222 | DM01688 | 2 POLY-IG RECEPTOR. | DM01688I 14.97 6.279e-09 75–123 |
| 224 | PR00308 | TYPE I ANTIFREEZE PROTEIN SIGNATURE | PR00308C 3.83 2.523e-10 40–50<br>PR00308C 3.83 8.892e-10 41–51<br>PR00308C 3.83 8.892e-10 42–52<br>PR00308B 4.28 6.671e-09 40–52 |

TABLE 3-continued

| SEQ ID NO: | ACCESSION NO. | DESCRIPTION | RESULTS* |
|---|---|---|---|
| 231 | BL00300 | SRP54-type proteins GTP-binding domain proteins. | BL00300C 25.57 6.000e-09 215–269 |
| 232 | BL00514 | Fibrinogen beta and gamma chains C-terminal domain proteins. | BL00514C 17.41 9.463e-19 233–270<br>BL00514E 14.28 7.750e-12 293–310<br>BL00514D 15.35 9.824e-11 274–287<br>BL00514G 15.98 4.273e-10 356–386<br>BL00514H 14.95 6.217e-09 391–416 |
| 233 | BL01158 | Macrophage migration inhibitory factor family proteins. | BL01158A 21.81 4.130e-30 2–47<br>BL01158B 17.07 4.316e-29 47–74 |
| 234 | BL00456 | Sodium: solute symporter family proteins. | BL00456A 22.59 6.250e-40 46–101<br>BL00456C 24.55 6.586e-40 184–239<br>BL00456B 18.94 8.125e-25 122–152<br>BL00456D 6.92 5.500e-10 476–486 |
| 237 | PR00830 | ENDOPEPTIDASE LA (LON) SERINE PROTEASE (S16) SIGNATURE | PR00830A 8.41 4.780e-14 241–261 |
| 238 | PR00165 | ANION EXCHANGER SIGNATURE | PR00165I 10.02 8.412e-14 829–849<br>PR00165A 9.84 6.423e-13 495–518<br>PR00165B 15.26 9.090e-11 520–541<br>PR00165F 10.39 6.663e-10 639–658 |
| 239 | BL00027 | 'Homeobox' domain proteins. | BL00027 26.43 7.943e-14 65–108 |
| 241 | BL00115 | Eukaryotic RNA polymerase II heptapeptide repeat proteins. | BL00115Z 3.12 2.047e-10 469–518 |
| 244 | BL01215 | Mrp family proteins. | BL01215A 9.75 2.436e-09 466–493 |
| 245 | PR00303 | PREPROTEIN TRANSLOCASE SECY SUBUNIT SIGNATURE | PR00303G 10.45 8.759e-09 88–111 |
| 249 | PF00429 | ENV polyprotein (coat polyprotein). | PF00429 31.08 8.015e-16 415–465 |
| 250 | BL00415 | Synapsins proteins. | BL00415N 4.29 7.115e-10 224–268 |
| 252 | BL00183 | Ubiquitin-conjugating enzymes proteins. | BL00183 28.97 4.326e-22 81–129 |
| 254 | BL00237 | G-protein coupled receptors proteins. | BL00237A 27.68 4.214e-16 108–148<br>BL00237C 13.19 3.323e-11 245–272<br>BL00237B 5.28 2.227e-09 182–194 |
| 255 | BL00237 | G-protein coupled receptors proteins. | BL00237A 27.68 4.214e-16 108–148<br>BL00237C 13.19 3.323e-11 280–307<br>BL00237B 5.28 2.227e-09 217–229 |
| 259 | PR00259 | TRANSMEMBRANE FOUR FAMILY SIGNATURE | PR00259B 14.81 3.769e-21 50–77<br>PR00259C 16.40 4.000e-20 77–106<br>PR00259A 9.27 3.600e-16 12–36 |
| 260 | BL00282 | Kazal serine protease inhibitors family proteins. | BL00282 16.88 7.207e-14 562–585 |
| 261 | PF00922 | Vesiculovirus phosphoprotein. | PF00922A 19.17 7.724e-09 88–122 |
| 266 | PR00049 | WILM'S TUMOUR PROTEIN SIGNATURE | PR00049D 0.00 7.143e-10 17–32 |
| 267 | BL00612 | Osteonectin domain proteins. | BL00612E 13.12 3.947e-11 379–424 |
| 268 | BL00223 | Annexins repeat proteins domain proteins. | BL00223A 15.59 1.000e-33 147–181<br>BL00223A 15.59 1.435e-16 75–109<br>BL00223C 24.79 3.928e-15 134–189 |
| 269 | BL00223 | Annexins repeat proteins domain proteins. | BL00223B 28.47 1.000e-40 188–238<br>BL00223A 15.59 1.000e-33 119–153<br>BL00223A 15.59 1.435e-16 47–81<br>BL00223C 24.79 3.928e-15 106–161 |
| 270 | BL00223 | Annexins repeat proteins domain proteins. | BL00223A 15.59 1.000e-33 119–153<br>BL00223A 15.59 1.435e-16 47–81<br>BL00223C 24.79 3.928e-15 106–161 |
| 273 | BL00086 | Cytochrome P450 cysteine heme-iron ligand proteins. | BL00086 20.87 8.615e-27 423–455 |
| 274 | PR00385 | P450 SUPERFAMILY SIGNATURE | PR00385A 14.97 5.696e-13 295–313 |
| 275 | BL00477 | Alpha-2-macroglobulin family thiolester region proteins. | BL00477A 13.50 9.182e-19 70–99 |
| 277 | BL00500 | Thymosin beta-4 family proteins. | BL00500 9.77 2.565e-28 2–42 |
| 279 | PR00320 | G-PROTEIN BETA WD-40 REPEAT SIGNATURE | PR00320A 16.74 4.971e-10 231–246<br>PR00320C 13.01 8.200e-10 231–246<br>PR00320B 12.19 9.486e-10 231–246<br>PR00320B 12.19 3.475e-09 188–203<br>PR00320B 12.19 4.600e-09 315–330<br>PR00320C 13.01 4.900e-09 315–330 |
| 288 | PF00580 | UvrD/REP helicase. | PR00580D 13.15 8.920e-13 670–684<br>PF00580E 13.89 2.800e-11 867–886<br>PF00580F 8.62 9.438e-10 913–926 |

TABLE 3-continued

| SEQ ID NO: | ACCESSION NO. | DESCRIPTION | RESULTS* |
|---|---|---|---|
| 289 | PR00019 | LEUCINE-RICH REPEAT SIGNATURE | PR00019B 11.36 1.000e-09 64–78<br>PR00019A 11.19 8.000e-09 90–104 |
| 290 | PD00126 | PROTEIN REPEAT DOMAIN TPR NUCLEA. | PD00126A 22.53 5.500e-10 229–250 |
| 295 | DM01206 | CORONAVIRUS NUCLEOCAPSID PROTEIN. | DM01206B 10.69 4.759e-09 464–484 |
| 297 | BL00972 | Ubiquitin carboxyl-terminal hydrolases family 2 proteins. | BL00972A 11.93 8.054e-15 191–209 |
| 298 | PF00023 | Ank repeat proteins. | PF00023A 16.03 9.500e-12 347–363<br>PF00023A 16.03 8.500e-10 283–299<br>PF00023A 16.03 8.875e-10 184–200 |
| 300 | BL00415 | Synapsins proteins. | BL00415Q 2.23 8.297e-09 13–49 |
| 302 | BL01113 | C1q domain proteins. | BL01113B 18.26 2.500e-13 841–877 |
| 304 | BL01248 | Laminin-type EGF-like (LE) domain proteins. | BL01248 11.02 7.171e-12 258–271<br>BL01248 11.02 7.943e-12 325–338 |
| 305 | BL00164 | Enolase proteins. | BL00164A 11.58 2.800e-28 41–64 |
| 307 | BL01153 | NOL1/NOP2/sun family proteins. | BL01153D 19.69 8.322e-14 102–128<br>BL01153C 13.67 6.507e-10 51–65 |
| 308 | BL00892 | HIT family proteins. | BL00892B 16.86 1.000e-20 130–154<br>BL00892A 18.17 6.657e-20 64–95 |
| 309 | PF00791 | Domain present in ZO-1 and Unc5-like netrin receptors. | PF00791B 28.49 4.146e-10 73–128 |
| 310 | BL00615 | C-type lectin domain proteins. | BL00615B 12.25 5.200e-12 166–180 |
| 311 | BL00071 | Glyceraldehyde 3-phosphate dehydrogenase proteins. | BL00071B 21.70 1.000e-40 80–126<br>BL00071C 11.81 1.000e-40 146–181<br>BL00071D 19.39 3.118e-25 184–239<br>BL00071E 11.48 4.600e-24 308–329<br>BL00071A 5.81 2.607e-14 5–17 |
| 314 | PR00926 | MITOCHONDRIAL CARRIER PROTEIN SIGNATURE | PR00926F 17.75 2.688e-10 15–38<br>PR00926D 10.53 6.625e-10 21–40 |
| 315 | PR00654 | ANGIOTENSINOGEN SIGNATURE | PR00654A 15.64 1.540e-26 23–44<br>PR00654D 10.48 3.538e-26 153–175<br>PR00654F 15.16 8.071e-26 255–275<br>PR00654E 9.81 2.241e-25 194–200<br>PR006540 9.50 5.500e-21 115–135 |
| 316 | BL00290 | Immunoglobulins and major histocompatibility complex proteins. | BL00290A 20.89 8.071e-17 34–57 |
| 317 | BL00290 | Immunoglobulins and major histocompatibility complex proteins. | BL00290A 20.89 7.600e-16 34–57 |
| 318 | BL00290 | Immunoglobulins and major histocompatibility complex proteins. | BL00290A 20.89 2.800e-16 31–54 |
| 319 | BL00290 | Immunoglobulins and major histocompatibility complex proteins. | BL00290A 20.89 9.400e-16 34–57 |
| 320 | BL00290 | Immunoglobulins and major histocompatibility complex proteins. | BL00290B 13.17 4.000e-21 282–300<br>BL00290A 20.89 4.600e-16 34–57<br>BL00290A 20.89 2.421e-13 225–248 |
| 321 | BL00290 | Immunoglobulins and major histocompatibility complex proteins. | BL00290A 20.89 4.600e-16 34–57 |
| 323 | BL00290 | Immunoglobulins and major histocompatibility complex proteins. | BL00290A 20.89 8.071e-17 34–57 |
| 324 | BL00290 | Immunoglobulins and major histocompatibility complex proteins. | BL00290A 20.89 4.600e-16 34–57 |
| 325 | BL00290 | Immunoglobulins and major histocompatibility complex proteins. | BL00290A 20.89 4.600e-16 34–57 |
| 326 | PF00651 | BTB (also known as BR-C/Ttk) domain proteins. | PF00651 15.00 2.500e-14 46–59 |
| 333 | BL00972 | Ubiquitin carboxyl-terminal hydrolases family 2 proteins. | BL00972A 11.93 3.919e-15 101–119<br>BL00972B 9.45 7.577e-10 180–190 |
| 337 | PF00789 | Domain present in ubiquitin-regulatory proteins. | PF00789B 19.70 5.941e-09 213–234 |
| 338 | PF00789 | Domain present in ubiquitin-regulatory proteins. | PF00789B 19.70 5.941e-09 259–280 |
| 339 | PR00625 | DNAJ PROTEIN FAMILY SIGNATURE | PR00625A 12.84 3.000e-19 19–39<br>PR00625B 13.48 2.756e-17 47–68 |
| 340 | BL00518 | Zinc finger, C3HC4 type (RING finger) proteins. | BL00518 12.23 5.714e-10 24–33 |

TABLE 3-continued

| SEQ ID NO: | ACCESSION NO. | DESCRIPTION | RESULTS* |
|---|---|---|---|
| 341 | PR00500 | POLYCYSTIC KIDNEY DISEASE PROTEIN SIGNATURE | PR00500I 9.22 1.107e-31 2810–2833<br>PR00500G 3.68 1.087e-30 2525–2548<br>PR00500H 17.80 1.107e-29 2662–2684<br>PR00500E 6.99 1.106e-27 2350–2370<br>PR00500F 9.44 1.108e-26 2483–2503 |
| 343 | BL00415 | Synapsins proteins. | BL00415N 4.29 5.401e-09 136–180 |
| 344 | PD00930 | PROTEIN GTPASE DOMAIN ACTIVATION. | PD00930B 33.72 2.800e-23 229–270<br>PD00930A 25.62 5.021e-12 125–151 |
| 345 | BL00023 | Type II fibronectin collagen-binding domain proteins. | BL00023 24.31 8.043e-34 281–318<br>BL00023 24.31 5.320e-32 223–260<br>BL00023 24.31 5.800e-29 340–377 |
| 346 | BL00023 | Type II fibronectin collagen-binding domain proteins. | BL00023 24.31 8.043e-34 281–318<br>BL00023 24.31 5.320e-32 223–260<br>BL00023 24.31 5.800e-29 340–377 |
| 350 | DM01354 | kw TRANSCRIPTASE REVERSE II ORF2. | DM01354R 8.50 2.969e-22 2115–2145<br>DM01354S 11.61 1.692e-14 2145–2166 |
| 351 | BL00888 | Cyclic nucleotide-binding domain proteins. | BL00888B 14.79 4.706e-18 372–396<br>BL00868A 18.03 1.000e-08 354–371 |
| 353 | PF00615 | Regulator of G protein signalling domain proteins. | PR00615B 16.25 9.625e-16 73–90<br>PR00615C 10.06 9.206e-12 150–164 |
| 354 | BL00766 | Tetrahydrofolate dehydrogenase/cyclohydrolase proteins. | BL00766E 13.78 9.625e-39 191–228<br>BL00766C 25.86 4.375e-31 77–125<br>BL00766D 17.05 5.966e-25 152–182 |
| 355 | BL00180 | Glutamine synthetase proteins. | BL00180E 17.60 1.000e-40 154–206<br>BL00180D 13.26 2.174e-24 119–141<br>BL00180F 10.05 6.211e-17 218–231<br>BL00180G 10.20 8.435e-17 307–322<br>BL00180C 12.14 4.600e-14 102–112<br>BL00180B 18.03 4.971e-14 68–87<br>BL00180A 13.20 5.065e-14 32–45 |
| 356 | BL00180 | Glutamine synthetase proteins. | BL00180F 10.05 6.750e-15 49–62 |
| 358 | BL01131 | Ribosomal RNA adenine dimethylases proteins. | BL01131A 26.62 1.000e-08 77–123 |
| 360 | DM00191 | w SPAC8A4.04C RESISTANCE SPAC8A4.05C DAUNORUBICIN. | DM00191A 8.16 5.440e-09 36–49 |
| 361 | DM00191 | w SPAC8A4.04C RESISTANCE SPAC8A4.05C DAUNORUBICIN. | DM00191A 8.16 5.440e-09 61–74 |
| 362 | PF00606 | Herpesviral Glycoprotein B. | PF00606I 20.74 7.894e-09 264–316 |
| 363 | PR00209 | ALPHA/BETA GLIADIN FAMILY SIGNATURE | PR00209B 4.88 9.080e-11 80–99<br>PR00209B 4.88 6.967e-10 86–105 |
| 364 | PR00528 | GLUCOCORTICOID RECEPTOR SIGNATURE | PR00528F 9.13 9.063e-09 31–51 |
| 365 | PF00622 | Domain in SPla and the RYanodine Receptor. | PF00622C 12.62 6.625e-13 759–773 |
| 366 | BL00420 | Speract receptor repeat proteins domain proteins. | BL00420B 22.67 2.824e-25 37–92<br>BL00420C 11.90 9.250e-12 122–133 |
| 367 | PR00080 | ALCOHOL DEHYDROGENASE SUPERFAMILY SIGNATURE | PR00080A 9.32 8.548e-10 122–134 |
| 369 | BL00263 | Natriuretic peptides proteins. | BL00263 11.87 5.909e-22 129–147 |
| 370 | BL00609 | Glycosyl hydrolases family 32 proteins. | BL00609C 13.27 9.270e-11 249–261 |
| 371 | PR00237 | RHODOPSIN-LIKE GPCR SUPERFAMILY SIGNATURE | PR00237E 13.03 4.000e-10 26–50 |
| 372 | BL00125 | Serine/threonine specific protein phosphatases proteins. | BL00125D 33.11 9.719e-35 23–78 |
| 373 | BL00453 | FKBP-type peptidyl-prolyl cis-trans isomerase proteins. | BL00453B 23.86 6.538e-26 281–315<br>BL00453A 15.57 8.364e-12 249–264<br>BL00453C 9.72 3.250e-11 323–336 |
| 374 | PR00497 | NEUTROPHIL CYTOSOL FACTOR P40 SIGNATURE | PR00497A 6.92 8.261e-09 310–328 |
| 375 | PR00449 | TRANSFORMING PROTEIN P21 RAS SIGNATURE | PR00449A 13.20 8.269e-16 34–56 |
| 376 | PR00109 | TYROSINE KINASE CATALYTIC DOMAIN SIGNATURE | PR00109B 12.27 9.847e-10 314–333 |
| 377 | PR00109 | TYROSINE KINASE CATALYTIC DOMAIN SIGNATURE | PR00109B 12.27 9.847e-10 314–333 |
| 378 | BL00472 | Small cytokines (intercrine/chemokine) C—C subfamily signatur. | BL00472C 20.76 8.225e-09 50–87 |

TABLE 3-continued

| SEQ ID NO: | ACCESSION NO. | DESCRIPTION | RESULTS* |
|---|---|---|---|
| 379 | PR00704 | CALPAIN CYSTEINE PROTEASE (C2) FAMILY SIGNATURE | PR007040 11.88 6.162e-09 132–149 |
| 380 | PR00705 | PAPAIN CYSTEINE PROTEASE (C1) FAMILY SIGNATURE | PR00705A 10.55 8.667e-13 155–171<br>PR00705B 10.22 2.385e-10 334–345 |
| 382 | PD01270 | RECEPTOR FC IMMUNOGLOBULIN AFFIN. | PD01270A 17.22 7.443e-10 129–169<br>PD01270A 17.22 7.387e-09 36–76 |
| 384 | BL00412 | Neuromodulin (GAP-43) proteins. | BL00412D 16.54 6.772e-10 250–301 |
| 385 | BL00232 | Cadherins extracellular repeat proteins domain proteins. | BL00232B 32.79 8.594e-35 151–199<br>BL00232B 32.79 5.579e-22 260–308<br>BL00232A 27.72 1.000e-20 57–90<br>BL00232C 10.65 3.613e-14 258–276<br>BL00232B 32.79 4.872e-11 377–425<br>BL00232C 10.65 3.211e-09 480–498 |
| 387 | BL00214 | Cytosolic fatty-acid binding proteins. | BL00214B 26.51 9.000e-29 47–92<br>BL00214A 21.17 1.000e-24 6–32 |
| 388 | PR00452 | SH3 DOMAIN SIGNATURE | PR00452B 11.65 8.250e-09 509–525 |
| 390 | BL00972 | Ubiquitin carboxyl-terminal hydrolases family 2 proteins. | BL00972A 11.93 8.759e-17 112–130<br>BL00972D 22.55 8.116e-12 354–379<br>BL00972B 9.45 7.088e-09 193–203 |
| 392 | BL00243 | Integrins beta chain cysteine-rich domain proteins. | BL00243I 31.77 3.155e-09 1–44 |
| 394 | BL00476 | Fatty acid desaturases family 1 proteins. | BL00476F 12.75 6.551e-09 45–90 |
| 397 | PR00320 | G-PROTEIN BETA WD-40 REPEAT SIGNATURE | PR00320A 16.74 9.690e-11 292–307<br>PR00320B 12.19 4.343e-10 292–307<br>PR00320C 13.01 7.840e-10 292–307 |
| 402 | PD01823 | PROTEIN INTERGENIC REGION ABC1 PRECURSOR MITOCHONDRION T. | PD01823D 16.66 3.093e-15 21–42<br>PD01823E 9.30 5.909e-15 75–88 |
| 404 | BL00540 | Ferritin iron-binding regions proteins. | BL00540A 15.06 1.000e-40 9–50<br>BL00540B 18.82 1.000e-40 100–155<br>BL00540C 13.00 7.500e-15 165–177 |
| 405 | PR00294 | STREPTOMYCES SUBTILISIN INHIBITOR SIGNATURE | PR00294A 10.44 6.444e-10 159–186 |
| 408 | BL00428 | Cell cycle proteins ftsW/rodA/spoVE proteins. | BL00428A 14.30 3.613e-09 91–110 |
| 411 | BL00142 | Neutral zinc metallopeptidases, zinc-binding region proteins. | BL00142 8.38 7.188e-10 389–400 |
| 412 | DM00191 | w SPAC8A4.04C RESISTANCE SPAC8A4.05C DAUNORUBICIN. | DM00191D 13.94 6.330e-11 232–271<br>DM00191D 13.94 7.728e-11 48–87<br>DM00191D 13.94 5.000e-10 112–151<br>DM00191D 13.94 5.667e-10 59–98<br>DM00191D 13.94 5.667e-10 123–162<br>DM00191D 13.94 6.583e-10 56–95<br>DM00191D 13.94 8.417e-10 280–319<br>DM00191D 13.94 8.917e-10 192–231<br>DM00191D 13.94 1.391e-09 224–263<br>DM00191D 13.94 2.409e-09 208–247<br>DM00191D 13.94 4.835e-09 120–159<br>DM00191D 13.94 5.304e-09 149–188<br>DM00191D 13.94 5.461e-09 211–250<br>DM00191D 13.94 6.322e-09 80–119<br>DM00191D 13.94 7.652e-09 243–282<br>DM00191D 13.94 8.513e-09 216–255<br>DM00191D 13.94 9.452e-09 177–216 |
| 415 | PR00023 | Ank repeat proteins. | PR00023A 16.03 1.321e-09 110–126 |
| 418 | PF00168 | C2 domain proteins. | PR00168C 27.49 9.250e-17 320–346 |
| 419 | PF00168 | C2 domain proteins. | PR00168C 27.49 9.250e-17 320–346 |
| 420 | BL00086 | Cytochrome P450 cysteine heme-iron ligand proteins. | BL00086 20.87 1.857e-20 444–476 |
| 422 | BL00218 | Amino acid permeases proteins. | BL00218D 21.49 9.757e-11 263–308 |
| 423 | PR00049 | WILM'S TUMOUR PROTEIN SIGNATURE | PR00049D 0.00 3.288e-09 35–50 |
| 424 | PR00380 | KINESIN HEAVY CHAIN SIGNATURE | PR00380A 14.18 4.086e-22 84–106<br>PR00380C 13.18 5.286e-17 240–259<br>PR00380D 9.93 7.698e-17 290–312<br>PR00380B 12.64 7.805e-14 207–225 |
| 425 | PR00049 | WILM'S TUMOUR PROTEIN SIGNATURE | PR00049D 0.00 1.915e-09 590–605 |
| 426 | BL00411 | Kinesin motor domain proteins. | BL00411H 15.66 7.811e-22 79–110<br>BL00411G 21.39 8.683e-22 31–73 |

TABLE 3-continued

| SEQ ID NO: | ACCESSION NO. | DESCRIPTION | RESULTS* |
|---|---|---|---|
| 428 | BL00790 | Receptor tyrosine kinase class V proteins. | BL00790E 29.58 6.667e-12 767–815 |
| 429 | BL00048 | Protamine P1 proteins. | BL00048 6.39 4.038e-09 396–423 |
| 433 | BL00107 | Protein kinases ATP-binding region proteins. | BL00107A 18.39 8.500e-27 342–373 |
| 434 | PR00910 | LUTEOVIRUS ORF6 PROTEIN SIGNATURE | PR00910A 2.51 6.036e-09 48–61 |
| 440 | PR00019 | LEUCINE-RICH REPEAT SIGNATURE | PR00019A 11.19 7.261e-10 69–83<br>PR00019B 11.36 4.600e-09 66–80 |
| 444 | BL00018 | EF-hand calcium-binding domain proteins. | BL00018 7.41 6.870e-09 42–55 |
| 448 | BL00790 | Receptor tyrosine kinase class V proteins. | BL00790B 21.59 1.000e-40 61–113<br>BL00790C 16.65 1.000e-40 165–219<br>BL00790K 9.30 1.000e-40 657–711<br>BL00790Q 15.61 1.000e-40 855–904<br>BL00790O 7.68 5.929e-39 797–830<br>BL00790G 22.06 5.114e-36 376–420<br>BL00790R 16.20 7.469e-36 951–995<br>BL00790E 29.58 7.250e-35 273–321<br>BL00790J 14.21 8.200e-33 605–645<br>BL00790N 13.25 1.214e-31 763–790<br>BL00790I 20.01 1.931e-29 501–532<br>BL00790D 12.41 2.500e-27 243–268<br>BL00790H 13.42 6.478e-27 455–481<br>BL00790M 8.74 8.683e-25 741–763<br>BL00790P 12.33 3.755e-24 830–855<br>BL00790F 15.90 5.200e-24 339–366<br>BL00790L 11.16 5.909e-21 721–741<br>BL00790A 19.74 1.964e-19 31–53 |
| 453 | BL00027 | 'Homeobox' domain proteins. | BL00027 26.43 2.000e-11 84–127 |
| 455 | BL01160 | Kinesin light chain repeat proteins. | BL01160B 19.54 5.958e-09 387–441 |
| 456 | BL01113 | Clq domain proteins. | BL01113B 18.26 2.500e-13 841–877 |
| 458 | BL01206 | Amiloride-sensitive sodium channels proteins. | BL01206D 30.58 3.025e-28 363–412<br>BL01206G 21.72 6.063e-27 530–576<br>BL01206F 16.40 7.643e-15 485–506<br>BL01206E 20.72 5.650e-14 427–454<br>BL01206C 12.30 3.455e-12 333–352<br>BL01206B 13.56 1.205e-10 313–327 |
| 460 | BL01220 | Phosphatidylethanolamine-binding protein family proteins. | BL01220B 16.65 1.000e-40 59–100<br>BL01220C 14.75 5.846e-34 100–128<br>BL01220A 22.62 3.400e-31 21–52 |
| 461 | BL00815 | Alpha-isopropylmalate and homocitrate synthases proteins. | BL00815C 21.36 3.118e-09 786–815 |
| 464 | PR00049 | WILM'S TUMOUR PROTEIN SIGNATURE | PR00049D 0.00 4.051e-09 1–16 |
| 470 | PD00066 | PROTEIN ZINC-FINGER METAL-BINDI. | PD00066 13.92 5.200e-09 453–466 |
| 471 | BL00022 | EGF-like domain proteins. | BL00022A 7.48 5.000e-09 177–184<br>BL00022A 7.48 5.000e-09 241–248<br>BL00022A 7.48 8.000e-09 49–56 |
| 473 | PR00371 | FLAVOPROTEIN PYRIDINE NUCLEOTIDE CYTOCHROME REDUCTASE SIGNATURE | PR00371D 14.55 4.536e-11 385–405 |
| 474 | BL00028 | Zinc finger, C2H2 type, domain proteins. | BL00028 16.07 4.462e-11 1087–1104 |
| 475 | PR00260 | BACTERIAL CHEMOTAXIS SENSORY TRANSDUCER SIGNATURE | PR00260C 10.26 9.294e-09 146–167 |
| 476 | BL00845 | CAP-Gly domain proteins. | BL00845 16.43 6.442e-21 405–430<br>BL00845 16.43 9.820e-19 203–228 |
| 478 | PD00066 | PROTEIN ZINC-FINGER METAL-BINDI. | PD00066 13.92 3.769e-15 369–382<br>PD00066 13.92 4.462e-15 285–298<br>PD00066 13.92 2.800e-14 257–270<br>PD00066 13.92 5.200e-14 313–326<br>PD00066 13.92 8.962e-10 341–354 |
| 481 | PR00671 | INHIBIN BETA B CHAIN SIGNATURE | PR00671C 4.18 5.345e-09 9–29 |
| 483 | DM01803 | 1 HERPESVIRUS GLYCOPROTEIN H. | DM01803A 10.51 6.855e-09 215–236 |
| 484 | DM01803 | 1 HERPESVIRUS GLYCOPROTEIN H. | DM01803A 10.51 6.855e-09 251–272 |
| 486 | PR00545 | RETINOIC ACID RECEPTOR SIGNATURE | PR00545A 5.35 9.430e-09 383–398 |

TABLE 3-continued

| SEQ ID NO: | ACCESSION NO. | DESCRIPTION | RESULTS* |
|---|---|---|---|
| 488 | BL01238 | GDA1/CD39 family of nucleoside phosphatases proteins. | BL01238A 11.72 7.840e-16 76–91 |
| 489 | PD00930 | PROTEIN GTPASE DOMAIN ACTIVATION. | PD00930B 33.72 2.800e-26 1256–1297<br>PD00930A 25.62 3.864e-13 1152–1178 |
| 493 | BL00223 | Annexins repeat proteins domain proteins. | BL00223B 28.47 1.000e-40 140–190<br>BL00223C 24.79 1.000e-40 217–272<br>BL00223A 15.59 5.500e-32 21–55<br>BL00223A 15.59 4.783e-14 230–264<br>BL00223C 24.79 2.515e-10 8–63<br>BL00223A 15.59 6.250e-10 71–105 |
| 496 | DM01513 | CAMP-DEPENDENT PROTEIN KINASE REGULATORY CHAIN. | DM01513A 13.61 8.568e-14 15–56 |
| 497 | BL00603 | Thymidine kinase cellular-type proteins. | BL00603C 30.02 1.000e-40 152–207<br>BL00603A 20.71 4.500e-33 63–96<br>BL00603D 10.53 5.091e-18 217–232<br>BL00603B 11.39 3.455e-15 132–147 |
| 498 | PD01922 | PROTEIN PHOSPHODIESTERASE HYDROL. | PD01922B 21.83 7.328e-14 162–198 |
| 499 | BL00061 | Short-chain dehydrogenases/reductases family proteins. | BL00061B 25.79 1.931e-13 99–137 |
| 500 | BL01160 | Kinesin light chain repeat proteins. | BL01160B 19.54 5.958e-09 64–118 |
| 501 | PF00856 | SET domain proteins. | PF00856A 26.14 8.579e-11 5–42 |
| 504 | BL00030 | Eukaryotic RNA-binding region RNP-1 proteins. | BL00030B 7.03 3.400e-10 116–126 |
| 506 | PF00075 | RNase H. | PF00075D 10.71 7.000e-11 517–528<br>PF00075C 11.58 9.786e-11 484–496<br>PF00075B 12.56 4.073e-10 449–460<br>PF00075A 14.44 2.143e-09 402–419 |
| 508 | BL00262 | Insulin family proteins. | BL00262B 16.89 8.286e-17 68–88<br>BL00262A 12.48 4.600e-15 32–50 |
| 509 | PR00213 | MYELIN P0 PROTEIN SIGNATURE | PR00213E 5.51 9.775e-12 264–289 |
| 511 | BL00856 | Guanylate kinase proteins. | BL00856C 29.21 2.658e-26 539–587<br>BL00856B 9.61 2.946e-18 511–532 |
| 513 | PR00475 | HEXOKINASE FAMILY SIGNATURE | PR00475B 14.92 6.143e-26 186–212<br>PR00475E 16.08 2.742e-22 327–350<br>PR00475F 9.68 4.000e-20 407–430<br>PR00475A 14.06 3.118e-19 118–135<br>PR00475C 11.92 6.684e-19 239–256<br>PR00475G 9.08 1.692e-16 479–496<br>PR00475D 13.30 2.653e-13 262–277<br>PR00475G 9.08 2.650e-10 32–49 |
| 516 | PR00722 | CHYMOTRYPSIN SERINE PROTEASE FAMILY (S1) SIGNATURE | PR00722A 12.27 8.448e-14 56–72 |
| 518 | BL00291 | Prion protein. | BL00291A 4.49 9.379e-09 105–140 |
| 519 | PF00534 | Glycosyl transferases group 1. | PF00534B 14.47 9.581e-12 398–422 |
| 520 | PF01105 | emp24/gp25L/p24 family. | PF01105B 25.12 2.868e-25 126–178 |
| 521 | PF01105 | emp24/gp25L/p24 family. | PF01105B 25.12 2.868e-25 151–203 |
| 522 | PR00305 | 14-3-3 PROTEIN ZETA SIGNATURE | PR00305A 9.33 9.500e-36 37–67<br>PR00305E 13.01 4.316e-32 177–204<br>PR00305D 16.34 3.647e-30 150–177<br>PR00305F 15.95 1.964e-26 204–234<br>PR00305C 8.68 3.182e-26 115–138<br>PR00305B 9.99 4.857e-24 84–109<br>PR00305F 15.95 8.975e-15 215–245 |
| 526 | PF00642 | Zinc finger C-x8-C-x5-C-x3-H type (and similar). | PF00642 11.59 7.796e-10 676–687<br>PF00642 11.59 7.055e-09 276–287 |
| 527 | PF00588 | SpoU rRNA Methylase family. | PF00588B 17.18 8.200e-10 281–303 |
| 528 | BL01160 | Kinesin light chain repeat proteins. | BL01160B 19.54 5.653e-09 791–845 |
| 529 | PR00326 | GTP1/OBG GTP-BINDING PROTEIN FAMILY SIGNATURE | PR00326A 8.75 4.255e-14 364–385 |
| 531 | BL01305 | moaA/nifB/pqqE family proteins. | BL01305D 14.97 7.279e-09 7–22 |
| 532 | PR00918 | CALICIVIRUS NON-STRUCTURAL POLYPROTEIN FAMILY SIGNATURE | PR00915A 13.76 5.807e-09 458–479 |

TABLE 3-continued

| SEQ ID NO: | ACCESSION NO. | DESCRIPTION | RESULTS* |
|---|---|---|---|
| 533 | PR00171 | SUGAR TRANSPORTER SIGNATURE | PR00171E 14.87 1.000e-08 73–86 |
| 534 | DM01418 | 352 FIBRILLAR COLLAGEN CARBOXYL-TERMINAL. | DM01418A 20.83 5.650e-23 101–149<br>DM01418B 22.51 8.500e-11 166–208<br>DM01418C 20.48 8.655e-10 236–278 |
| 535 | DM01418 | 352 FIBRILLAR COLLAGEN CARBOXYL-TERMINAL. | DM01418A 20.83 5.650e-23 117–165<br>DM01418B 22.51 8.500e-11 182–224<br>DM01418C 20.48 8.655e-10 252–294 |
| 536 | BL01052 | Calponin family repeat proteins. | BL01052B 15.31 3.308e-11 30–56 |
| 538 | BL00795 | Involucrin proteins. | BL00795C 17.06 7.600e-09 239–284 |
| 542 | BL01046 | ATP-dependent serine proteases, lon family, serine active sit. | BL01046D 19.61 4.938e-35 452–493<br>BL01046C 17.03 9.581e-31 377–421<br>BL01046B 19.24 4.977e-29 331–377 |
| 543 | BL00824 | Elongation factor 1 beta/beta'/delta chain proteins. | BL00824B 9.21 2.338e-09 150–170 |
| 547 | BL00615 | C-type lectin domain proteins. | BL00615A 16.68 3.880e-11 47–65<br>BL00615B 12.25 2.286e-10 149–163 |
| 550 | PR00119 | P-TYPE CATION-TRANSPORTING ATPASE SUPERFAMILY SIGNATURE | PR00119B 13.94 8.714e-12 35–50<br>PR00119E 8.48 7.716e-11 420–440 |
| 551 | BL00039 | DEAD-box subfamily ATP-dependent helicases proteins. | BL00039D 21.67 3.455e-33 476–522<br>BL00039A 18.44 8.548e-23 145–184<br>BL00039C 15.63 8.500e-16 277–301<br>BL00039B 19.19 1.837e-12 191–217 |
| 553 | BL00115 | Eukaryotic RNA polymerase II heptapeptide repeat proteins. | BL00115Z 3.12 9.669e-09 116–165 |
| 554 | PF00168 | C2 domain proteins. | PF00168B 11.83 8.000e-10 38–49 |
| 555 | PP00791 | Domain present in ZO-1 and Unc5-like netrin receptors. | PF00791B 28.49 4.165e-13 780–835<br>PF00791B 28.49 6.767e-10 888–943<br>PF00791C 20.98 8.059e-09 794–833 |
| 556 | PF00023 | Ank repeat proteins. | PF00023A 16.03 5.875e-10 437–453<br>PF00023A 16.03 7.000e-10 563–579<br>PF00023A 16.03 8.500e-10 248–264<br>PF00023A 16.03 9.250e-10 95–111<br>PF00023A 16.03 3.250e-09 596–612<br>PF00023A 16.03 3.893e-09 716–732<br>PF00023A 16.03 6.786e-09 62–78<br>PF00023A 16.03 9.036e-09 496–512 |
| 557 | BL00479 | Phorbol esters/diacylglycerol binding domain proteins. | BL00479B 12.57 8.714e-09 143–159 |
| 558 | BL00479 | Phorbol esters/diacylglycerol binding domain proteins. | BL00479B 12.57 8.714e-09 167–183 |
| 559 | BL00518 | Zinc finger, C3HC4 type (RING finger) proteins. | BL00518 12.23 5.286e-10 239–248 |
| 562 | BL00122 | Carboxylesterases type-B serine proteins. | BL00122G 11.67 2.500e-15 15–26 |
| 563 | PR00910 | LUTEOVIRUS ORF6 PROTEIN SIGNATURE | PR00910A 2.51 1.986e-11 340–353<br>PR00910A 2.51 1.986e-11 342–355<br>PR00910A 2.51 1.986e-11 344–357<br>PR00910A 2.51 9.778e-10 346–359<br>PR00910A 2.51 1.107e-09 338–351<br>PR00910A 2.51 3.464e-09 336–349 |
| 564 | DM01970 | 0 kw ZK632.12 YDR313C ENDOSOMAL III. | DM01970B 8.60 8.475e-15 175–188 |
| 566 | PR00833 | POLLEN ALLERGEN POA PI SIGNATURE | PR00833H 2.30 8.375e-10 149–164<br>PR00833H 2.30 2.846e-09 147–162 |
| 567 | PF00992 | Troponin. | PF00992A 16.67 3.368e-09 448–483 |
| 573 | PR00019 | LEUCINE-RICH REPEAT SIGNATURE | PR00019A 11.19 7.333e-09 322–336<br>PR00019B 11.36 9.280e-09 319–333 |
| 574 | BL00315 | Dehydrins proteins. | BL00315A 9.35 7.197e-10 93–121 |
| 576 | PD00930 | PROTEIN GTPASE DOMAIN ACTIVATION. | PD00930B 33.72 4.240e-16 235–276 |
| 577 | BL00183 | Ubiquitin-conjugating enzymes proteins. | BL00183 28.97 8.338e-14 44–92 |
| 579 | PR00019 | LEUCINE-RICH REPEAT SIGNATURE | PR00019B 11.36 6.850e-10 132–146<br>PR00019A 11.19 2.667e-09 135–149<br>PR00019B 11.36 9.640e-09 180–194<br>PR00019B 11.36 1.000e-08 277–291 |
| 581 | BL00625 | Regulator of chromosome condensation (RCC1) proteins. | BL00625A 16.21 2.033e-16 567–596<br>BL00625B 17.69 4.205e-12 561–595<br>BL00625R 17.69 9.423e-11 93–127<br>BL00625B 17.69 1.444e-10 152–186<br>BL00625A 16.21 1.759e-10 99–128<br>BL00625A 16.21 2.739e-09 515–544 |

TABLE 3-continued

| SEQ ID NO: | ACCESSION NO. | DESCRIPTION | RESULTS* |
|---|---|---|---|
| | | | BL00625B 17.69 3.172e-09 43–77 |
| | | | BL00625A 16.21 4.170e-09 158–187 |
| 582 | BL00414 | Profilin proteins. | BL00414A 13.85 6.344e-13 2–16 |
| | | | BL00414E 15.46 6.283e-09 121–136 |
| 583 | BL00414 | Profilin proteins. | BL00414A 13.85 6.344e-13 2–16 |
| | | | BL00414E 15.46 6.283e-09 105–120 |
| 584 | PD00301 | PROTEIN REPEAT MUSCLE CALCIUM-BI. | PD00301A 10.24 8.200e-09 131–142 |
| 585 | DM01930 | 2 kw FINGER SMCX SMCY YDR096W. | DM01930F 14.16 1.310e-27 24–60 |
| 586 | BL00411 | Kinesin motor domain proteins. | BL00411G 21.39 2.200e-39 77–119 |
| | | | BL00411H 15.66 8.800e-33 125–156 |
| | | | BL00411F 14.77 6.250e-18 33–58 |
| 588 | BL00600 | Aminotransferases class-III pyridoxal-phosphate attachment si. | BL00600E 16.43 5.725e-15 164–193 |
| | | | BL00600G 12.43 7.000e-14 242–261 |
| | | | BL00600F 8.77 7.480e-11 207–220 |
| | | | BL00600D 8.71 1.750e-10 143–157 |
| 589 | BL00838 | Interleukins −4 and −13 proteins. | BL00838A 12.35 8.696e-09 136–155 |
| 591 | PR00121 | SODIUM/POTASSIUM-TRANSPORTING ATPASE SIGNATURE | PR00121D 16.72 3.012e-12 261–283 |
| 592 | BL00289 | Pentaxin family proteins. | BL00289A 30.36 9.03le-09 331–362 |
| 594 | BL01279 | Protein-L-isoaspartate (D-aspartate) O-methyltransferase signa. | BL01279A 24.27 1.000e-11 67–115 |
| 597 | BL00027 | 'Homeobox' domain proteins. | BL00027 26.43 4.462e-32 244–287 |
| 598 | PD00066 | PROTEIN ZINC-FINGER METAL-BINDI. | PD00066 13.92 6.400e-16 245–258 |
| | | | PD00066 13.92 8.615e-15 329–342 |
| | | | PD00066 13.92 6.000e-13 301–314 |
| | | | PD00066 13.92 4.857e-12 217–230 |
| | | | PD00066 13.92 1.346e-10 273–286 |
| | | | PD00066 13.92 8.200e-09 357–370 |
| 599 | BL00585 | Ribosomal protein S5 proteins. | BL00585B 18.78 6.143e-18 303–340 |
| | | | BL00585A 28.43 4.286e-16 220–272 |
| 600 | PR00482 | OMPTIN SERINE PROTEASE SIGNATURE | PR00482C 11.02 7.968e-09 816–842 |
| 601 | PR00500 | POLYCYSTIC KIDNEY DISEASE PROTEIN SIGNATURE | PR00500B 7.74 7.359e-10 56–77 |
| 603 | PR00917 | SMALL ROUND STRUCTURED VIRUS (C37) CYSTEINE PROTEASE FAMILY SIGNATURE | PR00917G 10.59 8.990e-09 812–830 |
| 605 | BL00028 | Zinc finger, C2H2 type, domain proteins. | BL00028 16.07 9.486e-09 109–126 |
| 607 | PF00638 | RanBP1 domain proteins. | PR00638 11.91 4.600e-18 67–82 |
| 608 | BL00406 | Actins proteins. | BL00406E 8.44 8.541e-28 323–373 |
| | | | BL00406B 5.47 1.375e-27 82–137 |
| | | | BL00406D 12.58 3.160e-26 266–321 |
| | | | BL00406C 6.75 6.943e-25 141–196 |
| | | | BL00406A 9.95 2.575e-20 7–42 |
| 610 | BL00048 | Protamine P1 proteins. | BL0004B 6.39 3.700e-09 153–180 |
| 611 | PR00315 | GTP-BINDING ELONGATION FACTOR SIGNATURE | PR00315A 11.81 5.688e-10 126–140 |
| 615 | PF00780 | Domain found in NIK1-like kinases, mouse citron and yeast ROM. | PR00780B 23.03 9.908e-09 14–57 |
| 619 | BL00162 | Eukaryotic-type carbonic anhydrases proteins. | BL00162C 17.78 1.000e-40 88–125 |
| | | | BL00162E 14.93 7.231e-39 171–204 |
| | | | BL00162F 22.68 5.050e-31 208–242 |
| | | | BL00162A 22.92 8.714e-30 16–47 |
| | | | BL00162D 15.06 7.158e-24 126–151 |
| | | | BL00162B 21.43 1.375e-19 51–74 |
| 620 | PR00457 | ANIMAL HAEM PEROXIDASE SIGNATURE | PR00457E 20.67 1.621e-24 414–441 |
| | | | PR00457D 16.81 8.258e-21 389–410 |
| | | | PR00457B 13.29 3.455e-18 223–239 |
| | | | PR00457G 17.45 7.000e-18 595–616 |
| | | | PR00457C 19.25 4.414e-16 371–390 |
| | | | PR00457H 15.90 8.650e-14 666–681 |
| | | | PR00457A 15.80 5.645e-12 169–181 |
| | | | PR00457F 13.69 8.875e-11 467–478 |
| 621 | BL01304 | ubiH/COQ6 monooxygenase family proteins. | BL01304A 8.05 3.571e-11 50–64 |

TABLE 3-continued

| SEQ ID NO: | ACCESSION NO. | DESCRIPTION | RESULTS* |
|---|---|---|---|
| 623 | BL00019 | Actinin-type actin-binding domain proteins. | BL00019D 15.33 3.880e-17 145–175 |
| 625 | BL00893 | mutT domain proteins. | BL00893 18.99 5.500e-16 127–152 |
| 626 | PF00632 | HECT-domain (ubiquitin-transferase). | PF00632B 18.45 7.000e-16 488–516<br>PF00632C 20.66 7.851e-14 533–565 |
| 628 | PR00239 | MOLLUSCAN RHODOPSIN C-TERMINAL TAIL SIGNATURE | PR00239E 1.58 9.566e-10 292–304 |
| 634 | BL01280 | Glucose inhibited division protein A family proteins. | BL01280A 15.97 6.727e-36 69–110<br>BL01280B 23.56 8.105e-27 128–180 |
| 638 | PR00413 | HALOACID DEHALOGENASE/EPOXIDE HYDROLASE FAMILY SIGNATURE | PR00413E 15.78 6.714e-09 70–87 |
| 639 | PD01861 | PROTEIN NUCLEAR RIBONUCLEOPROTEIN SMALL MRNA RNA. | PD01861A 14.06 6.318e-10 60–84 |
| 640 | PD00289 | PROTEIN SH3 DOMAIN REPEAT PRESYNA. | PD00289 9.97 6.586e-09 46–60 |
| 643 | BL00914 | Syntaxin/ epimorphin family proteins. | BL00914 24.91 1.250e-29 184–234 |
| 644 | PR00010 | TYPE II EGF-LIKE SIGNATURE | PR00010C 11.16 6.667e-11 363–374 |
| 645 | PR00625 | DNAJ PROTEIN FAMILY SIGNATURE | PR00625A 12.84 4.600e-20 14–34<br>PR00625B 13.48 8.759e-20 46–67 |
| 646 | PD02448 | TRANSCRIPTION PROTEIN DNA-BINDIN. | PD02448A 9.37 3.854e-09 351–390 |
| 650 | PD02446 | TRANSCRIPTION PROTEIN DNA-BINDIN. | PD02448A 9.37 1.511e-20 50–89<br>PD02448B 10.17 8.071e-19 89–137 |
| 654 | PR00403 | WW DOMAIN SIGNATURE | PR00403B 12.19 9.816e-11 144–159<br>PR00403B 12.19 8.167e-10 103–118 |
| 655 | PR00403 | WW DOMAIN SIGNATURE | PR00403B 12.19 9.816e-11 107–122 |
| 657 | PR00929 | AT-HOOK-LIKE DOMAIN SIGNATURE | PR00929B 4.38 4.600e-10 358–370 |
| 658 | PD02379 | AMINOTRANSFERASE BIOSYNTHESIS PHOSPHOSERINE SER. | PD02379E 11.43 1.000e-40 194–236<br>PD02379F 18.62 6.029e-35 245–284<br>PD02379H 16.03 5.235e-33 352–385<br>PD02379B 12.05 3.613e-31 80–113<br>PD02379A 15.57 2.800e-25 29–60<br>PD02379O 13.34 3.700e-21 119–139<br>PD02379D 11.83 9.419e-16 168–181<br>PD02379G 10.62 2.537e-14 313–328 |
| 659 | PD02379 | AMINOTRANSFERASE BIOSYNTHESIS PHOSPHOSERINE SER. | PD02379E 11.43 1.000e-40 194–236<br>PD02379F 18.62 6.029e-35 245–284<br>PD02379B 12.05 3.613e-31 80–113<br>PD02379A 15.57 2.800e-25 29–60<br>PD02379H 16.03 7.864e-23 306–339<br>PD02379O 13.34 3.700e-21 119–139<br>PD02379D 11.83 9.419e-16 168–181 |
| 662 | PR00874 | FUNGI-IV METALLOTHIONEIN SIGNATURE | PR00874C 4.37 6.625e-09 33–48 |
| 666 | BL00035 | 'POU' domain proteins. | BL00035B 14.46 6.236e-09 683–704 |
| 668 | PF00168 | C2 domain proteins. | PF00168C 27.49 8.412e-13 634–660 |
| 669 | PR00168 | C2 domain proteins. | PR00168C 27.49 8.412e-13 115–141 |
| 671 | PR00566 | DOPAMINE 1B RECEPTOR SIGNATURE | PR00566E 13.44 5.255e-18 466–483<br>PR00566A 9.32 3.000e-17 200–214<br>PR00566D 9.35 1.600e-12 446–455<br>PR00566C 11.44 2.184e-12 401–412<br>PR00566B 8.20 3.053e-11 341–351 |
| 672 | PR00169 | POTASSIUN CHANNEL SIGNATURE | PR00169A 16.77 7.851e-11 46–66 |
| 673 | DM00215 | PROLINE-RICH PROTEIN 3. | DM00215 19.43 7.529e-11 183–216 |
| 674 | BL00951 | ER lumen protein retaining receptor proteins. | BL00951B 14.23 1.670e-09 43–74 |
| 675 | BL00292 | Cyclins proteins. | BL00292B 20.31 3.925e-11 120–151 |
| 676 | PR00048 | C2H2-TYPE ZINC FINGER SIGNATURE | PR00048A 10.52 3.160e-09 111–125 |
| 677 | BL01226 | Hydroxymethylglutary 1-coenzyme A synthase proteins. | BL01226I 25.06 8.560e-09 256–304 |
| 681 | BL00030 | Eukaryotic RNA-binding region RNP-1 proteins. | BL00030A 14.39 1.563e-12 72–91<br>BL00030A 14.39 2.125e-12 156–175 |

TABLE 3-continued

| SEQ ID NO: | ACCESSION NO. | DESCRIPTION | RESULTS* |
|---|---|---|---|
| 689 | BL00740 | MAM domain proteins. | BL00740B 19.76 3.813e-09 637–658 |
| 693 | BL00027 | 'Homeobox' domain proteins. | BL00027 26.43 7.000e-11 93–136 |
| 698 | PR00259 | TRANSMEMBRANE FOUR FAMILY SIGNATURE | PR00259A 9.27 3.308e-18 19–43<br>PR00259C 16.40 9.800e-18 88–117<br>PR00259D 13.50 2.756e-15 238–265 |
| 703 | PR00669 | INHIBIN ALPHA CHAIN SIGNATURE | PR00669F 5.57 9.899e-09 223–241 |
| 704 | DM01292 | ESICULAR LUMEN DOMAIN. | DM01292L 12.54 9.505e-09 240–265 |
| 705 | PR00128 | COLIPASE SIGNATURE | PR00128D 9.77 6.250e-25 47–66<br>PR00128C 9.28 5.299e-20 24–47 |
| 708 | PR00049 | WILM'S TUMOUR PROTEIN SIGNATURE | PR00049D 0.00 9.929e-10 384–399 |
| 710 | BL01118 | Translation initiation factor SUI1 proteins. | BL01118B 26.75 8.579e-26 94–132<br>BL01118A 12.46 4.000e-13 77–92 |
| 711 | BL00811 | Oleosins proteins. | BL00811A 8.26 3.310e-09 120–158 |
| 712 | BL00674 | AAA-protein family proteins. | BL00674B 4.46 9.182e-11 184–206 |
| 713 | DM01871 | kw SSR LIGASE CYCLOFORMYL-TETRAHYDROFOLATE. | DM018710 20.79 9.836e-10 270–296 |
| 715 | PR00049 | WILM'S TUMOUR PROTEIN SIGNATURE | PR00049D 0.00 7.712e-09 95–110 |
| 717 | BL01181 | Ribosomal protein S21 proteins. | BL01181 15.43 2.500e-10 13–49 |
| 718 | PR00259 | TRANSMEMBRANE FOUR FAMILY SIGNATURE | PR002590 16.40 6.824e-16 88–117<br>PR00259A 9.27 3.423e-14 24–48<br>PR00259D 13.50 1.574e-13 238–265<br>PR00259B 14.81 8.714e-13 61–88 |
| 720 | PR00496 | NAPIN SIGNATURE | PR00496A 6.68 6.276e-09 21–43 |
| 723 | PR00237 | RHODOPSIN-LIKE GPCR SUPERFAMILY SIGNATURE | PR00237G 19.63 2.543e-11 670–697<br>PR00237A 11.48 3.000e-10 424–449 |
| 724 | BL00972 | Ubiquitin carboxyl-terminal terminal hydrolases family 2 proteins. | BL00972A 11.93 7.500e-20 36–54<br>BL00972D 22.55 6.806e-16 296–321<br>BL00972B 9.45 1.000e-13 116–126<br>BL00972E 20.72 8.773e-12 321–343 |
| 725 | PF00646 | F-box domain proteins. | PF00646A 14.37 6.906e-09 92–106 |
| 727 | BL00933 | FGGY family of carbohydrate kinases proteins. | BL00933D 24.01 7.545e-15 212–249<br>BL00933B 15.94 2.200e-09 54–65<br>BL00933E 13.80 3.543e-09 439–455<br>BL00933A 17.50 4.857e-09 20–44 |
| 728 | PR00876 | NEMATODE METALLOTHIONEIN SIGNATURE | PR00876B 7.66 1.887e-10 137–151 |
| 731 | PD01976 | KINASE DEHYDROGENASE TRANSFERASE. | PD01976A 8.95 1.493e-09 83–96 |
| 732 | BL00623 | GMC oxidoreductases proteins. | BL00623A 12.60 9.859e-10 12–31 |
| 735 | BL01172 | Ribosomal protein L44e proteins. | BL01172B 14.10 8.909e-38 15–57<br>BL01172C 16.78 7.188e-31 63–102 |
| 737 | DM01724 | kw ALLERGEN POLLEN CIM1 HOL-LI. | DM01724 8.14 5.909e-11 11–31<br>DM01724 8.14 6.591e-11 41–61<br>DM01724 8.14 6.831e-10 39–59<br>DM01724 8.14 8.697e-09 55–75 |
| 738 | PR00320 | G-PROTEIN BETA WD-40 REPEAT SIGNATURE | PR00320A 16.74 8.463e-09 73–88 |
| 742 | PD02269 | CYTIDINE DEAMINASE HYDROLASE ZINC AMINOHY. | PD022690 16.36 7.882e-17 79–92<br>PD02269A 10.06 1.000e-15 29–41<br>PD02269D 11.98 5.000e-14 110–125 |
| 743 | BL00790 | Receptor tyrosine kinase class V proteins. | BL00790D 12.41 8.297e-09 429–454 |
| 744 | BL00750 | Chaperonins TCP-1 proteins. | BL00750B 16.17 2.000e-39 69–119<br>BL00750A 20.07 8.286e-36 25–68<br>BL00750C 25.65 8.579e-23 152–184 |
| 746 | BL00415 | Synapsins proteins. | BL00415N 4.29 4.710e-10 225–269 |
| 748 | BL00028 | Zinc finger, C2H2 type domain proteins. | BL00028 16.07 1.000e-09 212–229<br>BL00028 16.07 6.143e-09 365–382 |
| 752 | BL00030 | Eukaryotic RNA-binding region RNP-1 proteins. | BL00030A 14.39 6.143e-13 332–351 |
| 753 | PF00023 | Ank repeat proteins. | PR00023A 16.03 8.500e-10 283–299<br>PF00023A 16.03 9.625e-10 347–363<br>PF00023A 16.03 1.321e-09 184–200<br>PF00023A 16.03 1.643e-09 150–166 |
| 754 | BL00107 | Protein kinases ATP-binding region proteins. | BL00107B 13.31 1.643e-10 202–218 |
| 760 | PR00671 | INHIBIN BETA B CHAIN SIGNATURE | PR006710 4.18 8.966e-09 212–232 |

TABLE 3-continued

| SEQ ID NO: | ACCESSION NO. | DESCRIPTION | RESULTS* |
|---|---|---|---|
| 761 | PR00678 | P13 KINASE P85 REGULATORY SUBUNIT SIGNATURE | PR00678H 9.13 7.805e-12 292–315 |
| 762 | PR00412 | EPOXIDE HYDROLASE SIGNATURE | PR00412C 11.30 2.421e-12 169–183<br>PR00412A 13.23 7.947e-12 104–123<br>PR00412B 12.59 7.429e-10 123–139 |
| 763 | PR00217 | 43 KD POSTSYNAPTIC PROTEIN SIGNATURE | PR00217C 10.91 7.247e-10 293–309 |
| 764 | PR00320 | G-PROTEIN BETA WD-40 REPEAT SIGNATURE | PR00320A 16.74 9.122e-09 277–292<br>PR00320A 16.74 9.780e-09 233–248<br>PR00320C 13.01 1.000e-08 233–248 |
| 765 | BL01230 | RNA methyltransferase trmA family proteins. | BL01230E 15.79 2.918e-11 487–503 |
| 771 | BL00039 | DEAD-box subfamily ATP-dependent helicases proteins. | BL00039D 21.67 2.957e-09 434–480 |
| 773 | PR00453 | VON WILLEBRAND FACTOR TYPE A DOMAIN SIGNATURE | PR00453A 12.79 2.957e-10 33–51 |
| 777 | PR00493 | BREAST CANCER TYPE I SUSCEPTIBILITY PROTEIN SIGNATURE | PR00493G 7.57 3.711e-14 693–714 |
| 778 | BL00443 | Glutamine amidotransferases class-II proteins. | BL00443F 16.68 8.714e-09 85–101 |
| 780 | DM01206 | CORONAVIRUS NUCLEOCAPSID PROTEIN. | DM01206B 10.69 7.288e-10 167–187 |
| 783 | BL01221 | PMP-22/EMP/MP20 family proteins. | BL012210 26.20 1.281e-34 59–104<br>BL01221D 13.99 5.966e-27 136–163<br>BL01221A 17.26 2.385e-26 1–29<br>BL01221B 13.29 1.000e-14 38–52 |
| 785 | BL00027 | 'Homeobox' domain proteins. | BL00027 26.43 4.000e-10 297–340 |
| 786 | BL00027 | 'Homeobox' domain proteins. | BL00027 26.43 4.000e-10 297–340 |
| 790 | BL00303 | S-100/ICaBP type calcium binding protein. | BL00303B 26.15 5.075e-13 73–110 |
| 792 | PD01941 | TRANSMEMBRANE COTRANSPORTER SYMP. | PD01941C 19.96 4.960e-16 84–139<br>PD01941B 15.02 2.093e-11 4–51 |
| 794 | BL00672 | Serine proteases, V8 family histidine proteins. | BL00672B 9.84 3.554e-09 214–231 |
| 797 | BL00674 | AAA-protein family proteins. | BL00674B 4.46 7.814e-10 360–382 |
| 798 | BL00674 | AAA-protein family proteins. | BL00674B 4.46 7.814e-10 360–382 |
| 799 | BL00215 | Mitochondrial energy transfer proteins. | BL00215A 15.82 9.591e-16 206–231<br>BL00215A 15.82 4.000e-15 104–129<br>BL00215A 15.82 9.400e-15 7–32<br>BL00215B 10.44 1.000e-10 154–167 |
| 801 | BL01013 | Oxysterol-binding protein family proteins. | BL01013A 25.14 5.500e-21 537–573<br>BL01013D 26.81 2.16le-18 807–851<br>BL01013C 9.97 4.231e-13 625–635<br>BL01013B 11.33 3.017e-11 603–614 |
| 803 | BL00711 | Lipoxygenases iron-binding binding region proteins. | BL00711I 18.56 8.630e-28 577–615<br>BL00711E 19.66 3.550e-22 414–451<br>BL00711G 21.83 9.100e-22 503–535<br>BL00711C 20.75 5.959e-19 268–297<br>BL00711D 17.56 1.923e-16 347–373<br>BL00711H 23.34 1.771e-12 535–574<br>BL00711F 19.79 2.086e-10 484–501 |
| 805 | PR00492 | RHO PROTEIN GDP DISSOCIATION INHIBITOR SIGNATURE | PR00492C 9.68 1.900e-23 122–139<br>PR00492B 9.77 8.579e-23 76–95<br>PR004920 14.82 8.200e-21 139–155<br>PR00492A 11.92 1.643e-18 60–76 |
| 808 | BL00378 | Hexokinases proteins. | BL00378A 19.01 8.500e-09 403–431 |
| 809 | BL00027 | 'Homeobox' domain proteins. | BL00027 26.43 8.615e-33 35–78 |
| 810 | PR00179 | LIPOCALIN SIGNATURE | PR00179B 9.56 1.000e-12 102–115<br>PR001790 19.02 1.000e-10 130–146<br>PR00179A 13.78 5.680e-10 37–50 |
| 811 | BL00290 | Immunoglobulins and major histocompatibility complex proteins. | BL00290A 20.89 1.818e-11 164–187 |
| 814 | BL00269 | Mammalian defensins proteins. | BL002690 16.52 7.158e-09 171–200 |
| 815 | BL00216 | Sugar transport proteins. | BL00216B 27.64 5.846e-09 141–191 |
| 818 | BL00456 | Sodium:solute symporter family proteins. | BL00456A 22.59 2.080e-30 83–138<br>BL00456C 24.55 3.721e-29 221–276<br>BL00456B 18.94 1.000e-22 159–189 |
| 819 | BL00142 | Neutral zinc metallopeptidases, zinc-binding region proteins. | BL00142 8.38 1.857e-09 494–505 |
| 820 | BL00509 | Ras GTPase-activating proteins. | BL00509B 10.28 1.643e-12 610–621 |

TABLE 3-continued

| SEQ ID NO: | ACCESSION NO. | DESCRIPTION | RESULTS* |
|---|---|---|---|
| 824 | PR00048 | C2H2-TYPE ZINC FINGER SIGNATURE | PR00048A 10.52 6.143e-13 252–266<br>PR00048A 10.52 7.429e-13 476–490<br>PR00048A 10.52 3.118e-12 336–350<br>PR00048A 10.52 3.118e-12 364–378<br>PR00048A 10.52 4.706e-12 504–518<br>PR00048A 10.52 8.412e-12 224–238<br>PR00048A 10.52 3.842e-11 392–406<br>PR00046A 10.52 6.211e-11 308–322<br>PR00048A 10.52 6.211e-11 448–462<br>PR00048B 6.02 7.231e-11 492–502<br>PR00048B 6.02 3.250e-10 240–250<br>PR00048A 10.52 6.870e-10 420–434<br>PR00048B 6.02 2.421e-09 380–390 |
| 825 | PR00122 | VACUOLAR ATP SYNTRASE 16 KD SUBUNIT SIGNATURE | PR00122D 9.97 7.214e-11 103–127<br>PR00122C 8.20 9.526e-10 76–103 |
| 826 | BL00518 | Zinc finger, C3HC4 type (RING finger), proteins. | BL00518 12.23 6.571e-10 30–39 |
| 828 | BL01160 | Kinesin light chain repeat proteins. | BL01160B 19.54 1.610e-09 33–87<br>BL01160B 19.54 9.619e-09 65–119 |
| 835 | PD02411 | PROTEIN TRANSCRIPTION REGULATION NUCLEAR. | PD02411 21.89 6.786e-15 3967–4001 |
| 836 | DM01970 | 0 kw ZK632.12 YDR313C ENDOSOMAL III. | DM01970B 8.60 9.423e-10 111–124 |
| 837 | PR00048 | C2H2-TYPE ZINC FINGER SIGNATURE | PR00048A 10.52 2.174e-10 177–191 |
| 842 | PF00922 | Vesiculovirus phosphoprotein. | PF00922A 19.17 7.724e-09 276–310 |
| 844 | PD02059 | CORE POLYPROTEIN PROTEIN GAG CONTAINS: P. | PD02059A 28.10 5.950e-10 34–75 |
| 846 | BL00326 | Tropomyosins proteins. | BL00326D 8.76 8.065e-09 165–206 |
| 847 | BL00326 | Tropomyosins proteins. | BL00326D 8.76 8.065e-09 173–214 |
| 849 | PR00563 | BETA-3 ADRENERGIC RECEPTOR SIGNATURE | PR00563B 3.98 8.141e-09 8–28 |
| 851 | PR00450 | RECOVERIN FAMILY SIGNATURE | PR00450C 12.22 1.570e-09 285–307 |
| 853 | PD00066 | PROTEIN ZINC-FINGER METAL-BINDI. | PD00066 13.92 8.800e-14 290–303<br>PD00066 13.92 4.000e-13 234–247<br>PD00066 13.92 4.429e-12 262–275<br>PD00066 13.92 9.217e-11 206–219<br>PD00066 13.92 3.769e-10 505–518<br>PD00066 13.92 4.115e-10 449–462<br>PD00066 13.92 4.462e-10 533–546<br>PD00066 13.92 6.538e-10 477–490 |
| 854 | BL00615 | C-type lectin domain proteins. | BL00615A 16.68 8.920e-11 137–155 |
| 855 | BL00615 | C-type lectin domain proteins. | BL00615A 16.68 8.920e-11 176–194 |
| 856 | BL00018 | EF-hand calcium-binding domain proteins. | BL00018 7.41 9.000e-14 65–78 |
| 858 | PR00019 | LEUCINE-RICH REPEAT SIGNATURE | PR00019B 11.36 1.000e-09 219–233 |
| 860 | PD02474 | SYNTHASE SMALL SUBUNIT ACETOLACT. | PD02474B 21.08 8.568e-09 199–238 |
| 861 | PF00922 | Vesiculovirus phosphoprotein. | PF00922A 19.17 1.000e-08 249–283 |
| 864 | PR00289 | DISINTEGRIN SIGNATURE | PR00289B 11.79 1.947e-09 522–535 |
| 866 | PF00242 | DNA polymerase (viral) N-terminal domain proteins. | PF00242F 12.18 8.522e-09 197–219 |
| 867 | PR00780 | LEUSERPIN 2 SIGNATURE | PR00780B 4.89 4.491e-09 262–285 |
| 868 | BL00226 | Intermediate filaments proteins. | BL00226D 19.10 8.027e-13 208–255 |
| 869 | PD01876 | ANTIGEN MELANOMA-ASSOCIATED MULTIGENE FAMILY TUM. | PD01876C 21.73 3.326e-15 461–534<br>PD01876C 21.73 3.045e-10 735–788 |
| 870 | PR00747 | GLYCOSYL HYDROLASE FAMILY 47 SIGNATURE | PR00747C 12.06 8.767e-09 337–356 |
| 872 | DM01782 | HYDROGENASE (FE) LARGE CHAIN. | DM01782C 13.88 4.400e-19 349–368<br>DM01782F 9.01 4.375e-18 499–515<br>DM01782B 17.29 3.412e-10 294–327 |
| 873 | BL00226 | Intermediate filaments proteins. | BL00226D 19.10 7.375e-38 321–368<br>BL00226B 23.86 7.107e-32 155–203<br>BL00226C 13.23 3.100e-19 220–251<br>BL00226A 12.77 7.000e-15 55–70<br>BL00226D 19.10 7.800e-09 254–301 |

TABLE 3-continued

| SEQ ID NO: | ACCESSION NO. | DESCRIPTION | RESULTS* |
|---|---|---|---|
| 874 | DM01415 | 6 SALIVARY GLUE PROTEIN. | DM01415B 13.78 9.518e-10 4–52 |
| 876 | PR00860 | VERTEBRATE METALLOTHIONEIN SIGNATURE | PR00860B 7.04 2.929e-20 74–88<br>PR00860A 5.46 5.655e-13 52–65<br>PR00860C 9.61 2.400e-12 88–98 |
| 877 | PR00360 | C2 DOMAIN SIGNATURE | PR00360B 13.61 7.136e-09 572–586 |
| 881 | DM01206 | CORONAVIRUS NUCLEOCAPSID PROTEIN. | DM01206B 10.69 8.767e-10 567–587<br>DM01206B 10.69 1.000e-09 563–583 |
| 882 | BL00092 | N-6 Adenine-specific DNA methylases proteins. | BL00092 5.35 2.000e-09 136–145 |
| 883 | PR00511 | TEKTIN SIGNATURE | PR00511A 13.59 3.700e-14 113–130 |
| 885 | PR00764 | COMPLEMENT C9 SIGNATURE | PR00764F 16.69 2.286e-09 158–179 |
| 887 | BL01279 | Protein-L-isoaspartate (D-aspartate) O-methyltransferase signa. | BL01279A 24.27 3.691e-09 419–467 |
| 889 | PD01719 | PRECURSOR GLYCOPROTEIN SIGNAL RE. | PD01719A 12.89 2.603e-11 259–287<br>PD01719A 12.89 8.105e-10 199–227 |
| 890 | BL01162 | Quinone oxidoreductase/ zeta-crystallin proteins. | BL01162C 22.80 1.269e-18 151–195<br>BL01162A 15.38 1.265e-11 64–87 |
| 893 | PD01066 | PROTEIN ZINC FINGER ZINC-FINGER METAL-BINDING NU. | PD01066 19.43 5.415e-26 46–85 |
| 894 | PD02910 | TRANSCRIPTION PROTEIN FACTOR REGULATION A. | PD02910A 15.43 9.839e-09 62–97 |
| 895 | PD02199 | SUBUNIT HYDROGEN ION TRANSPORT T. | PD02199A 20.58 1.000e-40 10–61<br>PD02199D 13.18 1.000e-40 364–405<br>PD02199F 15.02 1.000e-40 440–482<br>PD02199J 11.42 1.000e-40 723–762<br>PD02199K 15.22 1.000e-40 792–831<br>PD02199G 9.43 4.447e-24 531–555<br>PD02199B 27.90 1.474e-22 263–306<br>PD02199H 13.62 2.636e-21 576–599<br>PD02199E 7.56 8.642e-19 405–424<br>PD02199C 17.60 8.085e-14 313–329<br>PD02199I 8.90 4.780e-09 616–624 |
| 896 | BL00218 | Amino acid permeases proteins. | BL00218E 23.30 5.920e-10 343–383 |
| 897 | BL00048 | Protamine P1 proteins. | BL00048 6.39 9.526e-10 160–187 |
| 900 | BL00811 | Oleosins proteins. | BL00811B 10.57 9.791e-09 307–336 |
| 904 | BL00415 | Synapsins proteins. | BL00415N 4.29 4.153e-09 301–345 |
| 905 | BL00107 | Protein kinases ATP-binding region proteins. | BL00107A 18.39 3.250e-17 133–164 |
| 906 | PR00449 | TRANSFORMING PROTEIN P21 RAS SIGNATURE | PR00449A 13.20 4.971e-14 4–26 |
| 908 | BL00317 | WAP-type 'four-disulfide core' domain proteins. | BL00317B 14.58 3.550e-13 48–70 |
| 909 | BL01019 | ADP-ribosylation factors family proteins. | BL01019B 19.49 7.517e-21 95–150 |
| 910 | PD00066 | PROTEIN ZINC-FINGER METAL-BINDI. | PD00066 13.92 2.385e-15 128–141<br>PD00066 13.92 5.714e-12 100–113 |
| 911 | PR00048 | C2H2-TYPE ZINC FINGER SIGNATURE | PR00045A 10.52 1.000e-11 174–188<br>PR00048B 6.02 1.692e-11 162–172 |
| 912 | PF00651 | BTB (also known as BR-C/Ttk) domain proteins. | PR00651 15.00 2.895e-11 45–58 |
| 913 | DM00547 | 1 kw CHROMO BROMODOMAIN SHADOW GLOBAL. | DM00547F 23.43 7.643e-34 606–653<br>DM00547B 11.28 7.907e-16 155–169<br>DM00547C 17.30 8.650e-14 209–231<br>DM00547D 11.60 6.500e-13 277–291<br>DM00547E 13.94 1.000e-11 307–330 |
| 914 | BL01115 | GTP-binding nuclear protein ran proteins. | BL01115A 10.22 5.330e-11 18–62 |
| 919 | BL01283 | T-box domain proteins. | BL01283D 11.70 7.868e-31 59–92<br>BL01283C 13.05 2.537e-14 25–39 |
| 922 | DM01503 | 1 HERPESVIRUS GLYCOPROTEIN H. | DM01803A 10.51 8.699e-09 100–121 |
| 924 | BL00470 | Isocitrate and isopropylmalate dehydrogenases proteins. | BL00470A 16.25 5.179e-14 10–31<br>BL00470C 15.43 4.103e-10 223–238<br>BL00470E 16.52 1.900e-09 287–297 |
| 925 | PF00023 | Ank repeat proteins. | PF00023A 16.03 3.893e-09 44–60<br>PF00023B 14.20 9.182e-09 40–50 |
| 926 | PF00023 | Ank repeat proteins. | PF00023A 16.03 3.893e-09 72–88<br>PF00023B 14.20 9.182e-09 68–78 |

TABLE 3-continued

| SEQ ID NO: | ACCESSION NO. | DESCRIPTION | RESULTS* |
|---|---|---|---|
| 929 | PD01066 | PROTEIN ZINC FINGER ZINC-FINGER METAL-BINDING NU. | PD01066 19.43 2.019e-26 51–90 |
| 930 | PR00830 | ENDOPEPTIDASE LA (LON) SERINE PROTEASE (S16) SIGNATURE | PR00830A 8.41 4.927e-13 222–242 |
| 931 | BL00456 | Sodium:solute symporter family proteins. | BL00456A 22.59 1.957e-32 35–90<br>BL00456B 18.94 9.780e-17 111–141 |
| 932 | BL00456 | Sodium:solute symporter family proteins. | BL00456A 22.59 1.957e-32 35–90<br>BL00456C 24.55 1.225e-31 173–228<br>BL00456B 18.94 9.780e-17 111–141 |
| 936 | BL00290 | Immunoglobulins and major histocompatibility complex proteins. | BL00290A 20.89 1.818e-11 159–182 |
| 937 | PR00830 | ENDOPEPTIDASE LA (LON) SERINE PROTEASE (S16) SIGNATURE | PR0083CA 8.41 5.897e-10 352–372 |
| 938 | PF00651 | BTB (also known as BR-C/TtK) domain proteins. | PR00651 15.00 7.000e-10 50–63 |
| 939 | PD00306 | PROTEIN GLYCOPROTEIN PRECURSOR RE. | PD00306A 10.26 6.625e-13 544–558 |
| 940 | PD00306 | PROTEIN GLYCOPROTEIN PRECURSOR RE. | PD00306A 10.26 6.625e-13 544–558 |
| 941 | PD00306 | PROTEIN GLYCOPROTEIN PRECURSOR RE. | PD00306A 10.26 6.625e-13 544–558 |
| 942 | PF00938 | Lipoprotein. | PF00938E 19.50 6.096e-09 272–307 |
| 943 | PF00925 | GTP cyclohydrolase II. | PF00925F 13.23 9.850e-09 356–367 |
| 945 | BL00226 | Intermediate filaments proteins. | BL00226A 12.77 5.355e-13 139–154 |
| 947 | PF00035 | Double-stranded RNA binding motif. | PF00035B 12.06 7.750e-09 273–287 |
| 948 | PF00622 | Domain in SPla and the RYanodine Receptor. | PF00622B 21.00 9.250e-11 170–192 |

*Results include in order: accession number subtype; raw score; p-value; position of signature in amino acid sequence.

TABLE 4

| SEQ ID NO: | pFAM NAME | DESCRIPTION | p-value | pFAM SCORE |
|---|---|---|---|---|
| 2 | UCH-2 | Ubiquitin carboxyl-terminal hydrolase family 2 | 5.9e-26 | 99.7 |
| 5 | SH2 | Src homology domain 2 | 8.5e-22 | 66.5 |
| 6 | SH2 | Src homology domain 2 | 8.5e-22 | 66.5 |
| 7 | RCC1 | Regulator of chromosome condensation (RCC1) | 4.4e-18 | 68.4 |
| 14 | UQ_con | Ubiquitin-conjugating enzyme | 3.2e-49 | 176.9 |
| 15 | UQ_con | Ubiquitin-conjugating enzyme | 1.2e-68 | 241.5 |
| 20 | gntR | Bacterial regulatory proteins, gntR family | 0.062 | 11.4 |
| 21 | gntR | Bacterial regulatory proteins, gntR family | 0.062 | 11.4 |
| 23 | kinesin | Kinesin motor domain | 2.9e-128 | 439.5 |
| 27 | Kelch | Kelch motif | 7.9e-71 | 248.7 |
| 29 | kinesin | Kinesin motor domain | 1.9e-171 | 583.0 |
| 30 | pkinase | Eukaryotic protein kinase domain | 8.5e-09 | 35.7 |
| 32 | Aa_trans | Transmembrane amino acid transporter protein | 3.1e-53 | 190.3 |
| 34 | EGF | EGF-like domain | 3.9e-24 | 93.6 |
| 38 | ig | Immunoglobulin domain | 6.2e-06 | 24.2 |
| 39 | LRR | Leucine Rich Repeat | 1.1e-10 | 48.9 |
| 43 | CK_II_beta | Casein kinase II regulatory subunit | 4.5e-69 | 242.9 |
| 45 | COX6B | Cytochrome oxidase c subunit VIb | 0.064 | -6.7 |
| 46 | RNA_pol_B | RNA polymerase beta subunit | 0 | 1206.8 |
| 47 | zf-C3HC4 | Zinc finger, C3HC4 type (RING finger) | 2e-07 | 28.3 |
| 48 | HLH | Helix-loop-helix DNA-binding domain | 1.5e-07 | 38.5 |
| 49 | ras | Ras family | 3.3e-12 | 2.0 |
| 50 | pkinase | Eukaryotic protein kinase domain | 1.9e-43 | 157.8 |
| 52 | ig | Immunoglobulin domain | 7.2e-08 | 30.4 |
| 54 | PX | PX domain | 3.7e-06 | 33.9 |
| 65 | Defensin_propep | Defensin propeptide | 3e-25 | 97.3 |
| 67 | zf-C2H2 | Zinc finger, C2H2 type | 2e-55 | 197.5 |
| 71 | pentaxin | Pentaxin family | 3.4e-18 | 66.3 |
| 73 | SSF | Sodium:solute symporter family | 1.7e-05 | -65.8 |
| 75 | AMP-binding | AMP-binding enzyme | 1.1e-12 | -49.0 |
| 78 | transmembrane4 | Transmembrane 4 family | 6.4e-05 | 18.7 |
| 80 | zf-C2H2 | Zinc finger, C2H2 type | 4.9e-30 | 113.2 |

TABLE 4-continued

| SEQ ID NO: | pFAM NAME | DESCRIPTION | p-value | pFAM SCORE |
|---|---|---|---|---|
| 81 | fn3 | Fibronectin type III domain | 1.8e-13 | 58.2 |
| 83 | polyprenyl_synt | Polyprenyl synthetases | 0.015 | −83.6 |
| 84 | Defensin_propep | Defensin propeptide | 3e-25 | 97.3 |
| 85 | MAGE | MAGE family | 3.5e-34 | 127.0 |
| 86 | LRR | Leucine Rich Repeat | 7.7e-15 | 62.7 |
| 87 | Cytidylyltransf | Cytidylyltransferase | 1.4e-05 | 29.3 |
| 90 | lipase | Lipase | 2.5e-15 | 55.2 |
| 96 | homeobox | Homeobox domain | 1.1e-30 | 115.3 |
| 101 | fn3 | Fibronectin type III domain | 4.7e-78 | 272.7 |
| 102 | ig | Immunoglobulin domain | 0.00045 | 18.2 |
| 103 | MHC_I | Class I Histocompatibility antigen, domains alpha 1 and 2 | 6.7e-08 | 32.8 |
| 104 | Trans_recep | Transient receptor | 1.9e-34 | 115.7 |
| 105 | Tropomyosin | Tropomyosins | 0.0086 | 11.3 |
| 109 | p450 | Cytochrome P450 | 1.8e-61 | 217.6 |
| 116 | Tropomyosin | Tropomyosins | 0.0086 | 11.3 |
| 117 | Tropomyosin | Tropomyosins | 0.0086 | 11.3 |
| 118 | aa_permeases | Amino acid permease | 3.2e-06 | −173.3 |
| 120 | zf-C2H2 | Zinc finger, C2H2 type | 1.3e-124 | 427.4 |
| 122 | C2 | C2 domain | 1.1e-38 | 142.0 |
| 123 | ig | Immunoglobulin domain | 0.00079 | 17.4 |
| 127 | WD40 | WD domain, G-beta repeat | 9.6e-15 | 62.4 |
| 130 | FYVE | FYVE zinc finger | 7.4e-23 | 86.0 |
| 131 | PH | PH domain | 3.9e-25 | 94.8 |
| 133 | KRAB | KRAB box | 1.6e-24 | 94.9 |
| 134 | Ribosomal_L11 | Ribosomal protein L11 | 3.9e-64 | 226.5 |
| 136 | zf-C2H2 | Zinc finger, C2H2 type | 2.1e-185 | 629.4 |
| 137 | Band_7 | SPFH domain/Band 7 family | 6.5e-35 | 129.4 |
| 139 | TPR | TPR Domain | 5.3e-16 | 66.6 |
| 142 | WH1 | WH1 domain | 6.4e-05 | 29.8 |
| 143 | zf-DHHC | DHHC zinc finger domain | 0.033 | −11.5 |
| 147 | zf-C2H2 | Zinc finger, C2H2 type | 9.2e-82 | 285.0 |
| 149 | 7tm_2 | 7 transmembrane receptor (Secretin family) | 1.2e-22 | 88.7 |
| 151 | lectin_c | Lectin C-type domain | 0.0097 | 3.8 |
| 152 | PDZ | PDZ domain (Also known as DHR or GLGF). | 0.0031 | 24.2 |
| 153 | cadherin | Cadherin domain | 3.7e-95 | 329.6 |
| 155 | COesterase | Carboxylesterases | 7e-48 | 166.8 |
| 156 | DSPc | Dual specificity phosphatase, catalytic domain | 2.8e-29 | 110.7 |
| 157 | efhand | EF hand | 2.2e-14 | 61.2 |
| 159 | A2M | Alpha-2-macroglobulin family | 2.2e-07 | 25.5 |
| 160 | zf-C2H2 | Zinc finger, C2H2 type | 8.8e-68 | 238.6 |
| 161 | Nucleoside_tra2 | Na+ dependent nucleoside transporter | 8e-188 | 637.4 |
| 166 | ras | Ras family | 5.5e-31 | 116.4 |
| 167 | zf-C3HC4 | Zinc finger, C3HC4 type (RING finger) | 3.2e-06 | 24.4 |
| 168 | LRR | Leucine Rich Repeat | 1.3e-06 | 35.4 |
| 169 | RasGAP | GTPase-activator protein for Ras-like GTPase | 6.4e-28 | 106.2 |
| 172 | LMWPc | Low molecular weight phosphotyrosine protein phosphatase | 9.7e-56 | 198.6 |
| 175 | lectin_c | Lectin C-type domain | 5.4e-06 | 33.3 |
| 178 | PK | Pyruvate kinase | 5.4e-12 | 46.3 |
| 179 | vwa | von Willebrand factor type A domain | 4.1e-63 | 223.1 |
| 180 | neur_chan | Neurotransmitter-gated ion-channel | 1.5e-120 | 413.9 |
| 181 | C4 | C-terminal tandem repeated domain in type 4 procollagen | 1.4e-148 | 507.0 |
| 187 | zf-C2H2 | Zinc finger, C2H2 type | 1.2e-25 | 98.6 |
| 188 | Ribosomal_S2 | Ribosomal protein S2 | 3.3e-79 | 276.5 |
| 191 | ATP-synt_ab | ATP synthase alpha/beta family | 5.7e-09 | −1.3 |
| 192 | ATP-synt_ab | ATP synthase alpha/beta family | 3.1e-11 | 49.7 |
| 193 | ank | Ank repeat | 3.5e-33 | 123.7 |
| 195 | GTP_EFTU | Elongation factor Tu family | 8.1e-33 | 113.3 |
| 197 | RF-1 | Peptidyl-tRNA hydrolase domain | 0.00034 | 10.7 |
| 200 | WD40 | WD domain, G-beta repeat | 1e-05 | 32.4 |
| 201 | Band_41 | FERM domain (Band 4.1 family) | 5.3e-86 | 269.7 |
| 205 | pkinase | Eukaryotic protein kinase domain | 1.6e-90 | 314.1 |
| 207 | SCP | SCP-like extracellular protein | 1e-15 | 60.4 |
| 208 | ras | Ras family | 1.5e-15 | 40.0 |
| 211 | 6PF2K | 6-phosphofructo-2-kinase | 5.2e-152 | 518.4 |
| 212 | zf-C2H2 | Zinc finger, C2H2 type | 3e-104 | 359.8 |
| 215 | pkinase | Eukaryotic protein kinase domain | 3.2e-92 | 319.8 |
| 216 | Oxysterol_BP | Oxysterol-binding protein | 4.3e-48 | 173.2 |
| 219 | pentaxin | Pentaxin family | 2.6e-40 | 142.7 |
| 220 | zf-C3HC4 | Zinc finger, C3HC4 type (RING finger) | 6.2e-08 | 30.0 |
| 221 | Peptidase_M1 | Peptidase family M1 | 1.5e-182 | 529.4 |
| 222 | ig | Immunoglobulin domain | 3.1e-07 | 28.4 |
| 224 | BTB | BTB/POZ domain | 1.8e-27 | 104.7 |
| 225 | F-box | F-box domain. | 3.5e-05 | 30.6 |
| 229 | Na_Ca_Ex | Sodium/calcium exchanger protein | 1.1e-23 | 92.1 |
| 231 | lactamase_B | Metallo-beta-lactamase superfamily | 0.01 | −5.3 |
| 232 | fibrinogen_C | Fibrinogen beta and gamma chains, C-terminal globular domain | 7.5e-40 | 140.2 |

TABLE 4-continued

| SEQ ID NO: | pFAM NAME | DESCRIPTION | p-value | pFAM SCORE |
|---|---|---|---|---|
| 233 | MIF | Macrophage migration inhibitory factor (MIF) | 5.4e-66 | 232.7 |
| 234 | SSF | Sodium:solute symporter family | 1.7e-234 | 792.4 |
| 235 | Cation_efflux | Cation efflux family | 2.2e-63 | 224.0 |
| 237 | AAA | ATPases associated with various cellular activities (AAA) | 2.6e-85 | 296.8 |
| 238 | HCO3_cotransp | HCO3- transporter family | 0 | 1395.3 |
| 239 | homeobox | Homeobox domain | 1.1e-14 | 62.2 |
| 243 | GST | Glutathione S-transferases. | 0.0024 | 14.4 |
| 244 | Viral_helicase1 | Viral (Superfamily 1) RNA helicase | 0.0019 | 14.7 |
| 245 | Na_Galacto_symp | Sodium:galactoside symporter family | 0.0068 | −94.4 |
| 246 | PPR | PPR repeat | 0.0024 | 24.5 |
| 249 | ENV_polyprotein | ENV polyprotein (coat polyprotein) | 3.9e-45 | 155.2 |
| 252 | UQ_con | Ubiquitin-conjugating enzyme | 7.6e-15 | 62.8 |
| 254 | 7tm_1 | 7 transmembrane receptor (rhodopsin family) | 2e-32 | 105.2 |
| 255 | 7tm_1 | 7 transmembrane receptor (rhodopsin family) | 9.6e-43 | 137.9 |
| 256 | UBA | UBA domain | 1.2e-08 | 42.1 |
| 259 | transmembrane4 | Transmembrane 4 family | 4.2e-44 | 144.0 |
| 267 | thyroglobulin_1 | Thyroglobulin type-1 repeat | 3.2e-35 | 130.4 |
| 268 | annexin | Annexin | 6.7e-80 | 278.9 |
| 269 | annexin | Annexin | 8.5e-122 | 418.0 |
| 270 | annexin | Annexin | 6.7e-80 | 278.9 |
| 271 | Armadillo_seg | Armadillo/beta-catenin-like repeats | 6.4e-06 | 33.1 |
| 273 | p450 | Cytochrome P450 | 2.3e-132 | 453.1 |
| 274 | p450 | Cytochrome P450 | 5.9e-52 | 186.0 |
| 275 | A2M_N | Alpha-2-macroglobulin family N-terminal region | 2.1e-72 | 247.4 |
| 277 | Thymosin | Thymosin beta-4 family | 2.3e-16 | 67.8 |
| 279 | WD40 | WD domain, G-beta repeat | 5.8e-19 | 76.4 |
| 288 | F-box | F-box domain. | 0.012 | 22.3 |
| 289 | LRR | Leucine Rich Repeat | 1.3e-17 | 72.0 |
| 290 | TPR | TPR Domain | 7.5e-54 | 192.3 |
| 293 | cadherin | Cadherin domain | 8.2e-07 | 36.1 |
| 297 | UCH-1 | Ubiquitin carboxyl-terminal hydrolases family 2 | 4.9e-08 | 40.1 |
| 298 | ank | Ank repeat | 9.1e-74 | 258.5 |
| 302 | C1q | C1q domain | 0.023 | 14.1 |
| 304 | laminin_Nterm | Laminin N-terminal (Domain VI) | 3.2e-52 | 186.9 |
| 305 | enolase | Enol-ase | 2.4e-69 | 243.8 |
| 307 | Nol1_Nop2_Sun | NOL1/NOP2/sun family | 0.0015 | 15.2 |
| 308 | HIT | HIT family | 3.2e-50 | 180.3 |
| 309 | ank | Ank repeat | 1e-20 | 82.3 |
| 310 | lectin_c | Lectin C-type domain | 8.8e-19 | 75.8 |
| 311 | gpdh | glyceraldehyde 3-phosphate dehydrogenases | 8.4e-237 | 793.9 |
| 314 | mito_carr | Mitochondrial carrier proteins | 2e-59 | 206.6 |
| 315 | serpin | Serpins (serine protease inhibitors) | 1.5e-109 | 372.9 |
| 316 | MHC_I | Class I Histocompatibility antigen, domains alpha 1 and 2 | 5.1e-141 | 481.9 |
| 317 | MHC_I | Class I Histocompatibility antigen, domains alpha 1 and 2 | 1.2e-132 | 454.1 |
| 318 | MHC_I | Class I Histocompatibility antigen, domains alpha 1 and 2 | 3.2e-122 | 419.4 |
| 319 | MHC_I | Class I Histocompatibility antigen, domains alpha 1 and 2 | 1.3e-119 | 410.8 |
| 320 | MHC_I | Class I Histocompatibility antigen, domains alpha 1 and 2 | 1.8e-122 | 420.3 |
| 321 | MHC_I | Class I Histocompatibility antigen, domains alpha 1 and 2 | 1.7e-131 | 450.2 |
| 323 | MHC_I | Class I Histocompatibility antigen, domains alpha 1 and 2 | 4e-144 | 492.2 |
| 324 | MHC_I | Class I Histocompatibility antigen, domains alpha 1 and 2 | 3.8e-105 | 362.7 |
| 325 | MHC_I | Class I Histocompatibility antigen, domains alpha 1 and 2 | 1.3e-139 | 477.2 |
| 326 | Kelch | Kelch motif | 1.4e-101 | 350.9 |
| 328 | Glycos_transf_2 | Glycosyl transferases | 1.9e-09 | 44.8 |
| 332 | ig | Immunoglobulin domain | 3.3e-07 | 28.3 |
| 333 | UCH-1 | Ubiquitin carboxyl-terminal hydrolases family 2 | 1.1e-12 | 55.6 |
| 336 | ATP-gua_Ptrans | ATP:guanido phosphotransferase | 4.1e-15 | 56.6 |
| 337 | UBX | UBX domain | 6.5e-18 | 72.9 |
| 338 | UBX | UBX domain | 6.5e-18 | 72.9 |
| 339 | DnaJ | DnaJ domain | 1e-36 | 135.4 |
| 340 | zf-C3HC4 | Zinc finger, C3HC4 type (RING finger) | 5.3e-07 | 26.9 |
| 341 | PKD | PKD domain | 0 | 1485.5 |
| 342 | CNH | CNH domain | 2.7e-24 | 94.2 |
| 344 | RhoGAP | RhoGAP domain | 1.8e-59 | 211.0 |
| 345 | Peptidase_M10 | Matrixin | 8.2e-110 | 378.2 |
| 346 | Peptidase_M10 | Matrixin | 8.2e-110 | 378.2 |
| 349 | UQ_con | Ubiquitin-conjugating enzyme | 2.6e-06 | 0.9 |
| 350 | ig | Immunoglobulin domain | 1.6e-236 | 767.1 |
| 351 | CNG_membrane | Transmembrane region cyclic Nucleotide Gated Channel | 3.7e-108 | 372.7 |
| 353 | RGS | Regulator of G protein signaling domain | 4.6e-49 | 176.4 |
| 354 | THF_DHG_CYH | Tetrahydrofolate dehydrogenase/cyclohydrolase | 5e-106 | 365.7 |
| 355 | gln-synt | Glutamine synthetase | 1.9e-194 | 612.3 |
| 356 | gln-synt | Glutamine synthetase | 2e-39 | 125.5 |
| 357 | SCAN | SCAN domain | 9.7e-61 | 215.2 |
| 358 | UPF0117 | Domain of unknown function DUF36 | 1.3e-38 | 131.0 |
| 359 | Trans_recep | Transient receptor | 0 | 1115.3 |
| 362 | Ammonium_transp | Ammonium Transporter Family | 1.9e-56 | 200.9 |

TABLE 4-continued

| SEQ ID NO: | pFAM NAME | DESCRIPTION | p-value | pFAM SCORE |
|---|---|---|---|---|
| 363 | Kelch | Kelch motif | 3.2e-50 | 180.3 |
| 365 | zf-C3HC4 | Zinc finger, C3HC4 type (RING finger) | 7.4e-26 | 88.2 |
| 366 | SRCR | Scavenger receptor cysteine-rich domain | 1.7e-25 | 98.1 |
| 367 | adh_short | short chain dehydrogenase | 1.1e-37 | 138.6 |
| 369 | ANP | Atrial natriuretic peptide | 1.5e-51 | 183.0 |
| 370 | EGF | EGF-like domain | 3.6e-26 | 100.4 |
| 372 | STphosphatase | Ser/Thr protein phosphatase | 1e-31 | 112.7 |
| 373 | FKBP | FKBP-type peptidyl-prolyl cis-trans isomerases | 1.7e-57 | 185.6 |
| 374 | PX | PX domain | 7.6e-16 | 66.1 |
| 375 | ras | Ras family | 5.2e-16 | 45.4 |
| 376 | pkinase | Eukaryotic protein kinase domain | 1.9e-56 | 200.9 |
| 377 | pkinase | Eukaryotic protein kinase domain | 1.9e-56 | 200.9 |
| 379 | Peptidase_C1 | Papain family cysteine protease | 4.6e-119 | 409.0 |
| 380 | Peptidase_C1 | Papain family cysteine protease | 7.4e-109 | 375.1 |
| 382 | ig | Immunoglobulin domain | 8.7e-10 | 36.6 |
| 384 | Sec7 | Sec7 domain | 4.5e-71 | 249.5 |
| 385 | cadherin | Cadherin domain | 2.7e-95 | 330.0 |
| 387 | lipocalin | Lipocalin/cytosolic fatty-acid binding protein family | 1e-35 | 127.1 |
| 388 | SH3 | SH3 domain | 1.5e-10 | 48.4 |
| 390 | UCH-2 | Ubiquitin carboxyl-terminal hydrolase family 2 | 1.8e-20 | 81.4 |
| 392 | RCC1 | Regulator of chromosome condensation (RCC1) | 1.5e-14 | 56.1 |
| 397 | crystall | Beta/Gamma crystallin | 3.3e-38 | 140.4 |
| 403 | PHD | PHD-finger | 6.7e-15 | 62.9 |
| 404 | ferritin | Ferritins | 4.1e-114 | 386.1 |
| 405 | CUB | CUB domain | 2.4e-13 | 57.8 |
| 406 | ATP-gua_Ptrans | ATP:guanido phosphotransferase | 5e-05 | 20.7 |
| 407 | SPRY | SPRY domain | 2e-09 | 44.8 |
| 410 | ELM2 | ELM2 domain | 9.4e-15 | 62.4 |
| 411 | Reprolysin | Reprolysin (M12B) family zinc metalloprotease | 7.2e-15 | 56.4 |
| 415 | ank | Ank repeat | 3.5e-18 | 73.8 |
| 418 | C2 | C2 domain | 1e-75 | 264.9 |
| 419 | C2 | C2 domain | 1e-75 | 264.9 |
| 420 | p450 | Cytochrome P450 | 9.8e-120 | 411.2 |
| 422 | aa_permeases | Amino acid permease | 1.3e-08 | −108.1 |
| 424 | kinesin | Kinesin motor domain | 1.9e-115 | 397.0 |
| 425 | LRR | Leucine Rich Repeat | 8.3e-26 | 99.2 |
| 426 | kinesin | Kinesin motor domain | 8e-63 | 222.1 |
| 427 | zf-DHHC | DHHC zinc finger domain | 9.1e-34 | 125.6 |
| 428 | EGF | EGF-like domain | 3.2e-45 | 163.6 |
| 432 | TWIK_channel | TASK K+ channel | 1.8e-09 | 7.9 |
| 433 | pkinase | Eukaryotic protein kinase domain | 2.3e-78 | 273.8 |
| 434 | PH | PH domain | 0.00018 | 21.0 |
| 436 | ig | Immunoglobulin domain | 9.2e-09 | 33.3 |
| 440 | LRR | Leucine Rich Repeat | 2.8e-16 | 67.5 |
| 441 | MACPF | MAC/Perforin domain | 0.016 | −71.3 |
| 444 | efhand | EF hand | 0.00027 | 27.7 |
| 448 | EPH_lbd | Ephrin receptor ligand binding domain | 7.9e-135 | 461.3 |
| 456 | C1q | C1q domain | 0.023 | 14.1 |
| 458 | ASC | Amiloride-sensitive sodium channel | 9.2e-127 | 434.5 |
| 459 | pkinase | Eukaryotic protein kinase domain | 0.083 | 10.4 |
| 460 | PBP | Phosphatidylethanolamine-binding protein | 1.2e-71 | 251.4 |
| 464 | rrm | RNA recognition motif. (a.k.a. RRM, RBD, or RNP domain) | 2.8e-12 | 54.2 |
| 466 | DEP | Domain found in Dishevelled, Egl-10, and Pleckstrin | 6.7e-18 | 72.9 |
| 470 | SCAN | SCAN domain | 4.3e-52 | 186.5 |
| 471 | EGF | EGF-like domain | 5.1e-28 | 106.5 |
| 473 | Ferric_reduct | Ferric reductase like transmembrane component | 6.8e-74 | 258.9 |
| 474 | zf-C2H2 | Zinc finger, C2H2 type | 5.7e-12 | 53.2 |
| 478 | CAP_GLY | CAP-Gly domain | 3.4e-46 | 166.9 |
| 477 | PAP2 | PAP2 superfamily | 4.9e-10 | 46.8 |
| 476 | SCAN | SCAN domain | 9.3e-70 | 245.2 |
| 480 | LRR | Leucine Rich Repeat | 1e-13 | 59.0 |
| 483 | PH | PH domain | 1e-15 | 61.2 |
| 484 | PH | PH domain | 2.3e-21 | 81.3 |
| 489 | RhoGAP | RhoGAP domain | 5.7e-57 | 202.7 |
| 493 | annexin | Annexin | 4.7e-70 | 246.2 |
| 495 | zf-C3HC4 | Zinc finger, C3HC4 type (RING finger) | 4.2e-06 | 24.0 |
| 497 | TK | Thymidine kinases | 9.4e-118 | 338.0 |
| 501 | PHD | PHD-finger | 0.01 | 8.3 |
| 504 | rrm | RNA recognition motif. (a.k.a. RRM, RBD, or RNP domain) | 1.3e-19 | 78.6 |
| 506 | rvt | Reverse transcriptase (RNA-dependent DNA polymerase) | 3.2e-30 | 113.8 |
| 508 | Insulin | Insulin/IGF/Relaxin family | 6.6e-22 | 86.2 |
| 510 | COX5A | Cytochrome c oxidase subunit Va | 1.2e-55 | 198.3 |
| 511 | Guanylate_kin | Guanylate kinase | 6.2e-38 | 139.4 |
| 513 | hexokinase | Hexokinase | 0 | 1029.0 |
| 516 | trypsin | Trypsin | 1.4e-78 | 250.0 |
| 519 | Glycos_transf_1 | Glycosyl transferases group 1 | 2.2e-27 | 102.8 |

TABLE 4-continued

| SEQ ID NO: | pFAM NAME | DESCRIPTION | p-value | pFAM SCORE |
|---|---|---|---|---|
| 520 | EMP24_GP25L | emp24/gp25L/p24 family | 3.5e-70 | 246.6 |
| 521 | EMP24_GP25L | emp24/gp25L/p24 family | 3.5e-81 | 283.1 |
| 522 | 14-3-3 | 14-3-3 proteins | 6.6e-150 | 511.4 |
| 526 | zf-CCCH | Zinc finger C-x8-C-x5-C-x3-H type (and similar). | 0.039 | 13.4 |
| 527 | SpoU_methylase | SpoU rRNA Methylase family | 2.1e-27 | 104.5 |
| 529 | MMR_HSR1 | GTPase of unknown function | 1.5e-90 | 314.2 |
| 531 | RNase PH | 3' exoribonuclease family | 2.2e-96 | 333.6 |
| 534 | COLFI | Fibrillar collagen C-terminal domain | 5.6e-50 | 129.2 |
| 535 | COLFI | Fibrillar collagen C-terminal domain | 3.1e-58 | 150.3 |
| 536 | CH | Calponin homology (CH) domain | 5.6e-14 | 59.9 |
| 541 | FH2 | Formin Homology 2 Domain | 4.5e-07 | −23.3 |
| 542 | AAA | ATPases associated with various cellular activities (AAA) | 5.5e-33 | 123.0 |
| 547 | lectin_c | Lectin C-type domain | 2.3e-29 | 111.0 |
| 551 | DEAD | DEAD/DEAH box helicase | 9.2e-58 | 185.6 |
| 554 | C2 | C2 domain | 1.3e-51 | 184.9 |
| 555 | ank | Ank repeat | 1.5e-26 | 101.6 |
| 556 | ank | Ank repeat | 6e-137 | 468.4 |
| 559 | zf-C3HC4 | Zinc finger, C3HC4 type (RING finger) | 1.1e-10 | 38.9 |
| 560 | ig | Immunoglobulin domain | 1.2e-81 | 268.2 |
| 562 | COesterase | Carboxylesterases | 1.4e-15 | 55.8 |
| 564 | FYVE | FYVE zinc finger | 3.8e-15 | 58.7 |
| 572 | SPRY | SPRY domain | 0.0059 | 2.8 |
| 573 | LRR | Leucine Rich Repeat | 0.0076 | 22.9 |
| 575 | Skp1 | Skp1 family | 6.3e-10 | 46.4 |
| 576 | RhoGAP | RhoGAP domain | 4.2e-31 | 116.8 |
| 577 | UQ_con | Ubiquitin-conjugating enzyme | 6.3e-50 | 179.3 |
| 579 | LRR | Leucine Rich Repeat | 8.7e-34 | 125.7 |
| 580 | K_tetra | K+ channel tetramerisation domain | 0.0016 | −5.0 |
| 581 | RCC1 | Regulator of chromosome condensation (RCC1) | 8.1e-10 | 39.5 |
| 582 | profilin | Profilins | 5.4e-63 | 222.7 |
| 583 | profilin | Profilins | 4e-48 | 173.3 |
| 585 | PHD | PHD-finger | 0.041 | 2.8 |
| 586 | kinesin | Kinesin motor domain | 5.2e-114 | 392.2 |
| 588 | aminotran_3 | Aminotransferases class-III pyridoxal-phosphate | 4e-75 | 217.6 |
| 593 | TPR | TPR Domain | 0.00036 | 27.3 |
| 594 | PCMT | Protein-L-isoaspartate (D-aspartate) O-methyltransferase (PCMT) | 1.6e-11 | 21.8 |
| 597 | homeobox | Homeobox domain | 6.1e-27 | 102.9 |
| 598 | zf-C2H2 | Zinc finger, C2H2 type | 6.8e-85 | 295.5 |
| 599 | Ribosomal_S5 | Ribosomal protein S5 | 9.9e-12 | 45.7 |
| 600 | IQ | IQ calmodulin-binding motif | 1.8e-18 | 74.8 |
| 604 | DUF6 | Integral membrane protein DUF6 | 0.083 | 9.1 |
| 605 | zf-C2H2 | Zinc finger, C2H2 type | 2.1e-05 | 31.4 |
| 606 | F-box | F-box domain. | 1.7e-05 | 31.7 |
| 607 | Ran_BP1 | RanBP1 domain. | 1.1e-88 | 308.0 |
| 608 | actin | Actin | 4.4e-156 | 513.5 |
| 611 | GTP_EFTU | Elongation factor Tu family | 8.5e-22 | 76.1 |
| 619 | carb_anhydrase | Eukaryotic-type carbonic anhydrase | 2.5e-171 | 582.6 |
| 620 | peroxidase | Peroxidase | 5.8e-208 | 704.3 |
| 621 | FAD_Gly3P_dh | FAD-dependent glycerol-3-phosphate dehydrogenase | 0.029 | −256.0 |
| 623 | CH | Calponin homology (CH) domain | 1.4e-25 | 98.4 |
| 625 | mutT | Bacterial | 4.3e-09 | 36.9 |
| 626 | HECT | HECT-domain (ubiquitin-transferase). | 4.3e-16 | 66.9 |
| 627 | ig | Immunoglobulin domain | 0.024 | 12.6 |
| 631 | Acetyltransf | Acetyltransferase (GNAT) family | 2.9e-12 | 54.2 |
| 632 | Acetyltransf | Acetyltransferase (GNAT) family | 2.9e-12 | 54.2 |
| 634 | pyr_redox | Pyridine nucleotide-disulphide oxidoreductase | 2.9e-05 | 20.5 |
| 639 | Sm | Sm protein | 1.3e-07 | 38.7 |
| 640 | PDZ | PDZ domain (Also known as DHR or GLGF). | 8.1e-15 | 62.7 |
| 643 | Syntaxin | Syntaxin | 2.3e-09 | 38.1 |
| 645 | DnaJ | DnaJ domain | 1.3e-39 | 145.1 |
| 646 | HMG_box | HMG (high mobility group) box | 2.7e-27 | 104.1 |
| 650 | HMG_box | HMG (high mobiiity group) box | 3.4e-30 | 113.7 |
| 653 | DUF6 | Integral membrane protein DUF6 | 3e-12 | 54.1 |
| 654 | FF | FF domain | 1.2e-33 | 125.2 |
| 655 | FF | FF domain | 1.2e-33 | 125.2 |
| 658 | aminotran_5 | Aminotransferases class-V | 1.3e-127 | 437.3 |
| 659 | aminotran_5 | Aminotransferases class-V | 3.5e-94 | 326.3 |
| 666 | SAM_PNT | Sterile alpha motif (SAM)/Pointed domain | 0.0021 | 6.9 |
| 667 | DUF52 | Protein of unknown function DUF52 | 4.7e-64 | 226.2 |
| 668 | C2 | C2 domain | 6.8e-36 | 132.7 |
| 669 | C2 | C2 domain | 7.8e-35 | 129.2 |
| 671 | 7tm_1 | 7 transmembrane receptor (rhodopsin family) | 2.4e-50 | 162.1 |
| 672 | K_tetra | K+ channel tetramerisation domain | 1.1e-25 | 98.7 |
| 675 | cyclin | Cyclin | 7.1e-14 | 52.2 |
| 676 | zf-C2H2 | Zinc finger, C2H2 type | 1.4e-18 | 75.2 |
| 679 | PDZ | PDZ domain (Also known as DHR or GLGF). | 4.3e-16 | 66.9 |

TABLE 4-continued

| SEQ ID NO: | pFAM NAME | DESCRIPTION | p-value | pFAM SCORE |
|---|---|---|---|---|
| 681 | rrm | RNA recognition motif. (a.k.a. RRM, RBD, or RNP domain) | 1.7e-47 | 171.2 |
| 689 | Gelsolin | Gelsolin repeat. | 8.5e-89 | 308.4 |
| 691 | TBC | TBC domain | 2e-08 | 15.3 |
| 692 | TBC | TBC domain | 2e-07 | 1.3 |
| 697 | GTP_CDC | Cell division protein | 2.3e-14 | 54.4 |
| 698 | transmembrane4 | Transmembrane 4 family | 1e-38 | 126.8 |
| 705 | Colipase | Colipase | 4.9e-21 | 83.3 |
| 706 | SH2 | Src homology domain 2 | 1.9e-05 | 19.4 |
| 710 | SUI1 | Translation initiation factor SUI1 | 5e-48 | 173.0 |
| 715 | SH3 | SH3 domain | 0.013 | 8.0 |
| 716 | UBA | UBA domain | 1.3e-09 | 45.4 |
| 717 | Ribosomal_S21 | Ribosomal protein S21 | 0.0039 | 11.7 |
| 718 | transmembrane4 | Transmembrane 4 family | 3.6e-52 | 169.8 |
| 723 | LRR | Leucine Rich Repeat | 1.1e-48 | 175.2 |
| 724 | UCH-2 | Ubiquitin carboxyl-terminal hydrolase family 2 | 5.6e-28 | 106.4 |
| 725 | F-box | F-box domain. | 0.0016 | 25.1 |
| 727 | FGGY | FGGY family of carbohydrate kinases | 5.8e-62 | 219.3 |
| 732 | pyr_redox | Pyridine nucleotide-disulphide oxidoreductase | 4.2e-23 | 80.9 |
| 733 | WD40 | WD domain, G-beta repeat | 0.073 | 19.6 |
| 735 | Ribosomal_L44 | Ribosomal protein L44 | 1e-38 | 142.1 |
| 738 | WD40 | WD domain, G-beta repeat | 1.3e-08 | 42.1 |
| 742 | dCMP_cyt_deam | Cytidine and deoxycytidylate deaminase zinc-binding region | 1.7e-09 | 45.0 |
| 743 | gntR | Bacterial regulatory proteins, gntR family | 0.062 | 11.4 |
| 744 | cpn60_TCP1 | TCP-1/cpn60 chaperonin family | 2.9e-74 | 260.1 |
| 748 | zf-C2H2 | Zinc finger, C2H2 type | 6.5e-15 | 63.0 |
| 751 | VHS | VHS domain | 1.7e-61 | 217.7 |
| 752 | rrm | RNA recognition motif. (a.k.a. RRM, RBD, or RNP domain) | 4.2e-23 | 90.2 |
| 753 | ank | Ank repeat | 1.4e-80 | 281.1 |
| 757 | cyclin | Cyclin | 0.026 | 11.5 |
| 761 | SH2 | Src homology domain 2 | 5.6e-05 | 18.0 |
| 762 | abhydrolase | alpha/beta hydrolase fold | 1.2e-21 | 85.3 |
| 763 | zf-C3HC4 | Zinc finger, C3HC4 type (RING finger) | 1.8e-05 | 22.0 |
| 764 | WD40 | WD domain, G-beta repeat | 1e-05 | 32.4 |
| 766 | Acyltransferase | Acyltransferase | 0.00021 | 15.9 |
| 771 | helicase_C | Helicases conserved C-terminal domain | 3e-15 | 64.1 |
| 772 | Na_Ca_Ex | Sodium/calcium exchanger protein | 8e-76 | 265.3 |
| 773 | vwa | von Willebrand factor type A domain | 9.6e-29 | 108.9 |
| 775 | DEAD | DEAD/DEAH box helicase | 0.042 | 9.5 |
| 776 | pkinase | Eukaryotic protein kinase domain | 1.6e-07 | 31.0 |
| 780 | rrm | RNA recognition motif. (a.k.a. RRM, RBD, or RNP domain) | 1.1e-05 | 32.3 |
| 782 | PX | PX domain | 1.5e-23 | 91.7 |
| 783 | PMP22_Claudin | PMP-22/EMP/MP20/Claudin family | 1.5e-56 | 201.3 |
| 785 | homeobox | Homeobox domain | 0.00021 | 23.9 |
| 786 | homeobox | Homeobox domain | 0.00021 | 23.9 |
| 790 | efhand | EF hand | 3.6e-18 | 73.8 |
| 793 | Glyco_hydro_31 | Glycosyl hydrolases family 31 | 9.8e-18 | 62.0 |
| 797 | Smr | Smr domain | 0.0029 | 13.0 |
| 798 | Smr | Smr domain | 0.0029 | 13.0 |
| 799 | mito_carr | Mitochondrial carrier proteins | 3.1e-61 | 212.8 |
| 801 | Oxysterol_BP | Oxysterol-binding protein | 3.4e-78 | 273.2 |
| 803 | lipoxygenase | Lipoxygenase | 1.7e-140 | 480.2 |
| 805 | Rho_GDI | RHO protein GDP dissociation inhibitor | 1.1e-122 | 420.9 |
| 809 | homeobox | Homeobox domain | 3.9e-32 | 120.2 |
| 810 | lipocalin | Lipocalin/cytosolic fatty-acid binding protein family | 8.5e-31 | 110.2 |
| 811 | ig | Immunoglobulin domain | 8.8e-14 | 49.5 |
| 814 | Keratin_B2 | Keratin, high sulfur B2 protein | 3.3e-07 | 32.9 |
| 815 | sugar_tr | Sugar (and other) transporter | 0.0057 | −109.4 |
| 817 | VPS9 | Vacuolar sorting protein 9 (VPS9) domain | 1.1e-37 | 138.7 |
| 818 | SSF | Sodium:solute symporter family | 5.9e-206 | 697.6 |
| 819 | Peptidase_M3 | Peptidase family M3 | 1.4e-280 | 945.5 |
| 820 | RasGAP | GTPase-activator protein for Ras-like GRPase | 1.3e-26 | 101.9 |
| 824 | zf-C2H2 | Zinc finger, C2H2 type | 2e-87 | 303.9 |
| 825 | ATP-synt_C | ATP synthase subunit C | 5.4e-08 | 40.0 |
| 826 | zf-C3HC4 | Zinc finger, C3HC4 type (RING finger) | 4.7e-13 | 46.6 |
| 827 | FH2 | Formin Homology 2 Domain | 9e-55 | 195.4 |
| 833 | SH3 | SH3 domain | 9.2e-14 | 59.2 |
| 835 | SET | SET domain | 9.9e-52 | 185.3 |
| 836 | zf-DHHC | DHHC zinc finger domain | 2.4e-25 | 97.7 |
| 837 | zf-C2H2 | ZinC finger, C2H2 type | 8.2e-14 | 59.3 |
| 840 | Trans_recep | Transient receptor | 0 | 1115.3 |
| 850 | Ribosomal_S12 | Ribosomal protein S12 | 1e-24 | 93.8 |
| 851 | Acyltransferase | Acyltransferase | 7.3e-06 | 32.2 |
| 853 | zf-C2H2 | Zinc finger, C2H2 type | 5.1e-80 | 279.2 |
| 854 | lectin_c | Lectin C-type domain | 2.8e-24 | 94.1 |
| 855 | lectin_c | Lectin C-type domain | 2.8e-24 | 94.1 |
| 856 | efhand | EF hand | 9.7e-10 | 45.8 |

TABLE 4-continued

| SEQ ID NO: | pFAM NAME | DESCRIPTION | p-value | pFAM SCORE |
|---|---|---|---|---|
| 858 | LRR | Leucine Rich Repeat | 3.1e-09 | 44.1 |
| 868 | filament | Intermediate filament proteins | 0.00027 | 20.0 |
| 869 | MAGE | MAGE family | 2.3e-19 | 77.8 |
| 871 | Hydrolase | haloacid dehalogenase-like hydrolase | 0.00056 | 12.6 |
| 872 | Fe_hyd_SSU | Iron hydrogenase small subunit | 0.00025 | 21.9 |
| 873 | filament | Intermediate filament proteins | 3.7e-143 | 489.0 |
| 874 | Keratin_B2 | Keratin, high sulfur B2 protein | 0.082 | −51.3 |
| 876 | metalthio | Metallothionein | 4.7e-23 | 90.0 |
| 877 | C2 | C2 domain | 4.7e-53 | 189.7 |
| 880 | efhand | EF hand | 0.041 | 20.5 |
| 885 | EGF | EGF-like domain | 1.1e-32 | 122.0 |
| 886 | 7tm_1 | 7 transmembrane receptor (rhodopsin family) | 0.003 | 12.5 |
| 887 | rrm | RNA recognition motif. (a.k.a. RRM, RBD, or RNP domain) | 0.058 | 15.6 |
| 888 | Kelch | Kelch motif | 5.3e-22 | 86.5 |
| 889 | tsp_1 | Thrombospondin type 1 domain | 0.0014 | 23.3 |
| 890 | adh_zinc | Zinc-binding dehydrogenases | 1.5e-55 | 197.9 |
| 891 | pkinase | Eukaryotic protein kinase domain | 3e-05 | 22.8 |
| 893 | zf-C2H2 | Zinc finger, C2H2 type | 2.1e-30 | 114.5 |
| 895 | V_ATPase_sub_a | V-type ATPase 116kDa subunit family | 0 | 1263.1 |
| 896 | aa_permeases | Amino acid permease | 5.6e-08 | −125.3 |
| 900 | MCT | Monocarboxylate transporter | 1e-42 | 155.3 |
| 901 | Filamin | Filamin/ABP280 repeat. | 2.3e-20 | 81.1 |
| 905 | ank | Ank repeat | 3.3e-88 | 306.5 |
| 906 | ras | Ras family | 1.4e-13 | 17.8 |
| 907 | Acyltransferase | Acyltransferase | 6.4e-34 | 126.1 |
| 908 | wap | WAP-type (Whey Acidic Protein) 'four-disulfide core' | 0.039 | 7.8 |
| 909 | arf | ADP-ribosylation factor family | 3.7e-11 | 25.6 |
| 910 | zf-C2H2 | Zinc finger, C2H2 type | 2.5e-09 | 44.4 |
| 911 | zf-C2H2 | Zinc finger, C2H2 type | 5.6e-20 | 79.8 |
| 912 | BTB | BTB/POZ domain | 1.1e-27 | 105.4 |
| 913 | SNF2_N | SNF2 and others N-terminal domain | 1.7e-71 | 250.9 |
| 914 | ras | Ras family | 2.4e-69 | 243.8 |
| 916 | rrm | RNA recognition motif. (a.k.a. RRM, RBD, or RNP domain) | 0.061 | 15.4 |
| 919 | T-box | T-box | 2.7e-45 | 159.8 |
| 923 | PH | PH domain | 1.5e-14 | 57.0 |
| 924 | isodh | Isocitrate and isopropylmalate dehydrogenases | 3.7e-125 | 421.5 |
| 925 | ank | Ank repeat | 2.5e-08 | 41.1 |
| 926 | ank | Ank repeat | 2.5e-08 | 41.1 |
| 928 | DUF51 | Protein of unknown function DUF51 | 5.7e-13 | 52.5 |
| 929 | zf-C2H2 | Zinc finger, C2H2 type | 2.1e-72 | 253.9 |
| 930 | AAA | ATPases associated with various cellular activities (AAA) | 1.1e-67 | 238.3 |
| 931 | SSF | Sodium:solute symporter family | 4.8e-170 | 578.3 |
| 932 | SSF | Sodium:solute symporter family | 1.3e-198 | 673.2 |
| 934 | aminotran_1 | Aminotransferases class-I | 2e-10 | 10.6 |
| 935 | DSPc | Dual specificity phosphatase, catalytic domain | 1.1e-29 | 112.1 |
| 936 | ig | Immunoglobulin domain | 2.7e-15 | 54.3 |
| 937 | MCM | MCM2/3/5 family | 1.9e-11 | −67.4 |
| 938 | Kelch | Kelch motif | 5.7e-56 | 199.4 |
| 939 | UBA | UBA domain | 2.7e-06 | 34.3 |
| 940 | UBA | UBA domain | 2.7e-06 | 34.3 |
| 941 | UBA | UBA domain | 2.7e-06 | 34.3 |
| 942 | Na_H_Exchanger | Sodium/hydrogen exchanger family | 0.00067 | −108.1 |
| 943 | Acyl-CoA_hydro | Cytosolic long-chain acyl-CoA thioester hydrolase | 9e-74 | 258.5 |
| 944 | zf-DHHC | DHHC zinc finger domain | 8.6e-18 | 72.5 |
| 945 | filament | Intermediate filament proteins | 5.6e-29 | 109.7 |
| 946 | SPRY | SPRY domain | 0.022 | −3.0 |
| 947 | dsrm | Double-stranded RNA binding motif | 1.5e-12 | 55.1 |
| 948 | SPRY | SPRY domain | 2.8e-11 | 50.9 |

TABLE 5

| SEQ ID NO: | POSITION OF SIGNAL IN AMINO ACID SEQUENCE | maxS (MAXIMUM SCORE) | meanS (MEAN SCORE) |
|---|---|---|---|
| 1 | 1-24 | 0.926 | 0.738 |
| 8 | 1-48 | 0.994 | 0.655 |
| 9 | 1-31 | 0.984 | 0.921 |
| 11 | 1-36 | 0.994 | 0.757 |
| 12 | 1-20 | 0.977 | 0.902 |
| 16 | 1-25 | 0.921 | 0.787 |
| 17 | 1-33 | 0.967 | 0.803 |
| 22 | 1-26 | 0.949 | 0.664 |
| 24 | 1-28 | 0.929 | 0.700 |
| 26 | 1-17 | 0.919 | 0.828 |
| 31 | 1-19 | 0.890 | 0.552 |
| 33 | 1-19 | 0.981 | 0.916 |

TABLE 5-continued

| SEQ ID NO: | POSITION OF SIGNAL IN AMINO ACID SEQUENCE | maxS (MAXIMUM SCORE) | meanS (MEAN SCORE) |
|---|---|---|---|
| 35 | 1-21 | 0.980 | 0.904 |
| 36 | 1-21 | 0.980 | 0.904 |
| 38 | 1-26 | 0.951 | 0.801 |
| 41 | 1-43 | 0.994 | 0.659 |
| 44 | 1-19 | 0.942 | 0.693 |
| 52 | 1-21 | 0.989 | 0.925 |
| 57 | 1-18 | 0.964 | 0.812 |
| 58 | 1-19 | 0.972 | 0.915 |
| 59 | 1-24 | 0.997 | 0.929 |
| 60 | 1-16 | 0.945 | 0.737 |
| 61 | 1-31 | 0.957 | 0.775 |
| 68 | 1-28 | 0.988 | 0.938 |
| 69 | 1-23 | 0.976 | 0.897 |
| 72 | 1-33 | 0.948 | 0.776 |
| 75 | 1-31 | 0.991 | 0.925 |
| 76 | 1-41 | 0.942 | 0.703 |
| 77 | 1-36 | 0.910 | 0.749 |
| 79 | 1-27 | 0.962 | 0.696 |
| 82 | 1-24 | 0.943 | 0.832 |
| 86 | 1-27 | 0.962 | 0.856 |
| 87 | 1-19 | 0.967 | 0.909 |
| 88 | 1-39 | 0.986 | 0.922 |
| 89 | 1-28 | 0.982 | 0.924 |
| 91 | 1-29 | 0.984 | 0.763 |
| 92 | 1-22 | 0.974 | 0.796 |
| 93 | 1-29 | 0.928 | 0.725 |
| 94 | 1-44 | 0.995 | 0.811 |
| 95 | 1-36 | 0.901 | 0.766 |
| 97 | 1-25 | 0.921 | 0.787 |
| 103 | 1-23 | 0.966 | 0.812 |
| 106 | 1-19 | 0.951 | 0.895 |
| 107 | 1-16 | 0.927 | 0.827 |
| 108 | 1-25 | 0.949 | 0.823 |
| 110 | 1-28 | 0.980 | 0.848 |
| 113 | 1-24 | 0.965 | 0.891 |
| 114 | 1-25 | 0.946 | 0.860 |
| 119 | 1-36 | 0.964 | 0.648 |
| 126 | 1-32 | 0.941 | 0.669 |
| 128 | 1-17 | 0.995 | 0.974 |
| 135 | 1-18 | 0.968 | 0.799 |
| 141 | 1-24 | 0.882 | 0.599 |
| 143 | 1-38 | 0.991 | 0.904 |
| 146 | 1-29 | 0.963 | 0.888 |
| 148 | 1-19 | 0.892 | 0.715 |
| 153 | 1-34 | 0.921 | 0.652 |
| 154 | 1-20 | 0.951 | 0.839 |
| 158 | 1-31 | 0.921 | 0.659 |
| 162 | 1-36 | 0.992 | 0.917 |
| 176 | 1-30 | 0.989 | 0.910 |
| 177 | 1-28 | 0.974 | 0.851 |
| 179 | 1-25 | 0.937 | 0.812 |
| 182 | 1-30 | 0.978 | 0.786 |
| 183 | 1-27 | 0.987 | 0.879 |
| 185 | 1-23 | 0.923 | 0.655 |
| 196 | 1-28 | 0.980 | 0.893 |
| 199 | 1-27 | 0.963 | 0.833 |
| 202 | 1-24 | 0.976 | 0.913 |
| 203 | 1-24 | 0.988 | 0.967 |
| 204 | 1-22 | 0.968 | 0.831 |
| 206 | 1-21 | 0.952 | 0.822 |
| 207 | 1-42 | 0.939 | 0.682 |
| 209 | 1-22 | 0.984 | 0.928 |
| 210 | 1-22 | 0.984 | 0.928 |
| 217 | 1-21 | 0.942 | 0.713 |
| 219 | 1-18 | 0.922 | 0.838 |
| 222 | 1-18 | 0.988 | 0.944 |
| 226 | 1-18 | 0.975 | 0.958 |
| 227 | 1-18 | 0.975 | 0.958 |
| 228 | 1-18 | 0.975 | 0.958 |
| 229 | 1-48 | 0.989 | 0.889 |
| 230 | 1-23 | 0.996 | 0.936 |
| 232 | 1-16 | 0.967 | 0.933 |
| 245 | 1-15 | 0.948 | 0.907 |
| 247 | 1-27 | 0.936 | 0.689 |
| 248 | 1-42 | 0.978 | 0.750 |
| 249 | 1-15 | 0.977 | 0.966 |
| 251 | 1-26 | 0.976 | 0.875 |
| 252 | 1-28 | 0.973 | 0.822 |
| 253 | 1-28 | 0.990 | 0.925 |
| 257 | 1-22 | 0.982 | 0.933 |
| 258 | 1-15 | 0.986 | 0.919 |
| 259 | 1-27 | 0.994 | 0.900 |
| 267 | 1-21 | 0.989 | 0.871 |
| 272 | 1-28 | 0.976 | 0.653 |
| 278 | 1-20 | 0.987 | 0.916 |
| 281 | 1-30 | 0.996 | 0.894 |
| 282 | 1-41 | 0.983 | 0.791 |
| 286 | 1-20 | 0.978 | 0.893 |
| 291 | 1-17 | 0.953 | 0.784 |
| 292 | 1-25 | 0.950 | 0.897 |
| 293 | 1-20 | 0.974 | 0.912 |
| 294 | 1-15 | 0.974 | 0.817 |
| 299 | 1-35 | 0.973 | 0.795 |
| 302 | 1-22 | 0.982 | 0.872 |
| 303 | 1-18 | 0.983 | 0.927 |
| 306 | 1-20 | 0.934 | 0.828 |
| 307 | 1-16 | 0.952 | 0.807 |
| 308 | 1-19 | 0.904 | 0.656 |
| 312 | 1-35 | 0.957 | 0.640 |
| 313 | 1-35 | 0.957 | 0.640 |
| 315 | 1-33 | 0.953 | 0.707 |
| 316 | 1-24 | 0.981 | 0.884 |
| 317 | 1-24 | 0.987 | 0.914 |
| 318 | 1-21 | 0.977 | 0.905 |
| 319 | 1-24 | 0.978 | 0.911 |
| 320 | 1-18 | 0.984 | 0.958 |
| 321 | 1-18 | 0.984 | 0.958 |
| 322 | 1-24 | 0.989 | 0.922 |
| 323 | 1-18 | 0.984 | 0.956 |
| 324 | 1-18 | 0.986 | 0.965 |
| 325 | 1-18 | 0.986 | 0.965 |
| 326 | 1-32 | 0.956 | 0.706 |
| 329 | 1-48 | 0.983 | 0.616 |
| 330 | 1-20 | 0.965 | 0.878 |
| 334 | 1-16 | 0.921 | 0.828 |
| 335 | 1-20 | 0.937 | 0.700 |
| 345 | 1-19 | 0.995 | 0.971 |
| 346 | 1-19 | 0.995 | 0.971 |
| 348 | 1-20 | 0.926 | 0.751 |
| 354 | 1-29 | 0.981 | 0.937 |
| 362 | 1-27 | 0.977 | 0.849 |
| 366 | 1-24 | 0.977 | 0.845 |
| 367 | 1-23 | 0.990 | 0.833 |
| 369 | 1-25 | 0.971 | 0.894 |
| 370 | 1-16 | 0.961 | 0.916 |
| 371 | 1-41 | 0.980 | 0.681 |
| 379 | 1-17 | 0.977 | 0.921 |
| 380 | 1-17 | 0.977 | 0.921 |
| 381 | 1-26 | 0.993 | 0.894 |
| 383 | 1-25 | 0.986 | 0.939 |
| 385 | 1-33 | 0.977 | 0.811 |
| 392 | 1-43 | 0.992 | 0.943 |
| 393 | 1-20 | 0.943 | 0.882 |
| 395 | 1-20 | 0.995 | 0.933 |
| 396 | 1-26 | 0.938 | 0.663 |
| 398 | 1-21 | 0.955 | 0.767 |
| 399 | 1-19 | 0.920 | 0.692 |
| 400 | 1-41 | 0.937 | 0.604 |
| 401 | 1-41 | 0.937 | 0.604 |
| 405 | 1-19 | 0.986 | 0.961 |
| 409 | 1-41 | 0.923 | 0.559 |
| 411 | 1-25 | 0.973 | 0.853 |
| 413 | 1-20 | 0.935 | 0.817 |
| 416 | 1-29 | 0.958 | 0.637 |
| 417 | 1-23 | 0.991 | 0.740 |
| 420 | 1-29 | 0.986 | 0.848 |
| 421 | 1-18 | 0.997 | 0.979 |
| 425 | 1-16 | 0.979 | 0.964 |

TABLE 5-continued

| SEQ ID NO: | POSITION OF SIGNAL IN AMINO ACID SEQUENCE | maxS (MAXIMUM SCORE) | meanS (MEAN SCORE) |
|---|---|---|---|
| 427 | 1-25 | 0.980 | 0.952 |
| 428 | 1-37 | 0.989 | 0.822 |
| 430 | 1-37 | 0.984 | 0.878 |
| 431 | 1-42 | 0.978 | 0.698 |
| 432 | 1-18 | 0.969 | 0.913 |
| 435 | 1-31 | 0.981 | 0.856 |
| 438 | 1-36 | 0.987 | 0.595 |
| 439 | 1-27 | 0.955 | 0.786 |
| 441 | 1-17 | 0.915 | 0.825 |
| 442 | 1-34 | 0.954 | 0.783 |
| 445 | 1-19 | 0.941 | 0.839 |
| 448 | 1-27 | 0.944 | 0.778 |
| 449 | 1-20 | 0.941 | 0.734 |
| 456 | 1-22 | 0.982 | 0.872 |
| 479 | 1-19 | 0.993 | 0.931 |
| 480 | 1-22 | 0.992 | 0.807 |
| 482 | 1-22 | 0.918 | 0.716 |
| 485 | 1-38 | 0.994 | 0.887 |
| 488 | 1-24 | 0.914 | 0.588 |
| 490 | 1-28 | 0.990 | 0.919 |
| 494 | 1-26 | 0.990 | 0.969 |
| 498 | 1-36 | 0.954 | 0.817 |
| 502 | 1-23 | 0.896 | 0.747 |
| 503 | 1-23 | 0.969 | 0.855 |
| 508 | 1-24 | 0.985 | 0.932 |
| 514 | 1-23 | 0.985 | 0.951 |
| 516 | 1-27 | 0.985 | 0.927 |
| 517 | 1-21 | 0.960 | 0.649 |
| 519 | 1-41 | 0.990 | 0.922 |
| 520 | 1-20 | 0.991 | 0.954 |
| 521 | 1-20 | 0.991 | 0.954 |
| 525 | 1-21 | 0.975 | 0.909 |
| 530 | 1-11 | 0.900 | 0.758 |
| 545 | 1-18 | 0.933 | 0.634 |
| 547 | 1-22 | 0.899 | 0.639 |
| 548 | 1-40 | 0.953 | 0.668 |
| 561 | 1-16 | 0.881 | 0.607 |
| 568 | 1-36 | 0.924 | 0.590 |
| 569 | 1-25 | 0.919 | 0.718 |
| 570 | 1-28 | 0.928 | 0.590 |
| 571 | 1-27 | 0.967 | 0.872 |
| 578 | 1-25 | 0.998 | 0.934 |
| 579 | 1-30 | 0.973 | 0.829 |
| 599 | 1-20 | 0.937 | 0.728 |
| 603 | 1-30 | 0.962 | 0.801 |
| 604 | 1-17 | 0.925 | 0.779 |
| 609 | 1-20 | 0.981 | 0.910 |
| 614 | 1-17 | 0.977 | 0.921 |
| 617 | 1-25 | 0.938 | 0.677 |
| 620 | 1-22 | 0.975 | 0.822 |
| 629 | 1-34 | 0.934 | 0.552 |
| 630 | 1-28 | 0.946 | 0.799 |
| 635 | 1-15 | 0.954 | 0.725 |
| 636 | 1-30 | 0.938 | 0.808 |
| 644 | 1-24 | 0.973 | 0.910 |
| 649 | 1-24 | 0.920 | 0.596 |
| 652 | 1-29 | 0.968 | 0.769 |
| 656 | 1-28 | 0.975 | 0.926 |
| 665 | 1-25 | 0.977 | 0.776 |
| 670 | 1-41 | 0.986 | 0.847 |
| 679 | 1-24 | 0.915 | 0.578 |
| 682 | 1-24 | 0.950 | 0.737 |
| 683 | 1-28 | 0.987 | 0.785 |
| 684 | 1-19 | 0.890 | 0.552 |
| 685 | 1-22 | 0.968 | 0.934 |
| 686 | 1-22 | 0.968 | 0.934 |
| 687 | 1-23 | 0.965 | 0.883 |
| 688 | 1-23 | 0.965 | 0.883 |
| 690 | 1-26 | 0.896 | 0.615 |
| 693 | 1-30 | 0.956 | 0.665 |
| 696 | 1-39 | 0.971 | 0.694 |
| 698 | 1-44 | 0.992 | 0.576 |
| 701 | 1-45 | 0.964 | 0.657 |
| 702 | 1-45 | 0.964 | 0.657 |
| 705 | 1-17 | 0.968 | 0.947 |
| 707 | 1-28 | 0.960 | 0.607 |
| 709 | 1-31 | 0.977 | 0.720 |
| 714 | 1-28 | 0.956 | 0.604 |
| 718 | 1-47 | 0.985 | 0.646 |
| 719 | 1-19 | 0.990 | 0.946 |
| 729 | 1-47 | 0.996 | 0.556 |
| 736 | 1-18 | 0.930 | 0.679 |
| 739 | 1-25 | 0.992 | 0.948 |
| 741 | 1-26 | 0.947 | 0.594 |
| 745 | 1-22 | 0.963 | 0.859 |
| 747 | 1-26 | 0.956 | 0.830 |
| 755 | 1-26 | 0.990 | 0.959 |
| 758 | 1-40 | 0.987 | 0.917 |
| 759 | 1-26 | 0.985 | 0.917 |
| 762 | 1-36 | 0.991 | 0.868 |
| 765 | 1-24 | 0.887 | 0.553 |
| 766 | 1-23 | 0.995 | 0.974 |
| 767 | 1-18 | 0.997 | 0.977 |
| 768 | 1-22 | 0.968 | 0.934 |
| 770 | 1-26 | 0.974 | 0.730 |
| 773 | 1-18 | 0.983 | 0.939 |
| 783 | 1-24 | 0.988 | 0.919 |
| 795 | 1-30 | 0.939 | 0.639 |
| 796 | 1-26 | 0.984 | 0.746 |
| 807 | 1-23 | 0.965 | 0.693 |
| 810 | 1-22 | 0.962 | 0.919 |
| 811 | 1-21 | 0.988 | 0.911 |
| 812 | 1-36 | 0.980 | 0.559 |
| 821 | 1-10 | 0.880 | 0.780 |
| 823 | 1-14 | 0.922 | 0.678 |
| 825 | 1-39 | 0.982 | 0.829 |
| 830 | 1-34 | 0.973 | 0.817 |
| 831 | 1-36 | 0.976 | 0.794 |
| 838 | 1-18 | 0.918 | 0.651 |
| 839 | 1-35 | 0.991 | 0.834 |
| 841 | 1-22 | 0.947 | 0.677 |
| 847 | 1-24 | 0.963 | 0.865 |
| 848 | 1-30 | 0.967 | 0.758 |
| 849 | 1-33 | 0.926 | 0.807 |
| 852 | 1-25 | 0.889 | 0.718 |
| 857 | 1-20 | 0.995 | 0.968 |
| 859 | 1-27 | 0.887 | 0.642 |
| 862 | 1-41 | 0.975 | 0.875 |
| 865 | 1-26 | 0.921 | 0.620 |
| 878 | 1-36 | 0.951 | 0.782 |
| 884 | 1-19 | 0.983 | 0.888 |
| 885 | 1-23 | 0.971 | 0.941 |
| 886 | 1-40 | 0.964 | 0.560 |
| 891 | 1-39 | 0.942 | 0.587 |
| 898 | 1-16 | 0.945 | 0.737 |
| 899 | 1-24 | 0.946 | 0.593 |
| 900 | 1-44 | 0.974 | 0.662 |
| 902 | 1-26 | 0.974 | 0.730 |
| 903 | 1-27 | 0.952 | 0.832 |
| 908 | 1-25 | 0.960 | 0.642 |
| 918 | 1-31 | 0.956 | 0.846 |
| 921 | 1-16 | 0.968 | 0.921 |
| 936 | 1-19 | 0.984 | 0.936 |
| 944 | 1-35 | 0.954 | 0.699 |

SEQUENCE LISTING (948 sequences)

SEQ ID NO: 1 - DNA, 1850 bp, Homo sapiens
  CDS (647)..(1030)
ggaacgcgcaccaccggccttcaccccttagggcgcgggaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaggaagcttggaagcggagtcttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcaaattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgaggatttgaagaaagaacacagagtccaccgtgcccaggacacaggtgttaaatggataggccgtctcaagcggaacacgtacccctggggcgctgtttacgccctccgaccccaaaagcaatcttgtttccttactcagtgtcctccattctagacagctacttaaaacctttgccgccctccgcccagtgcctcctttctcctctctggcaaaggaccctgcctcctccgccaggaaacaggtcagcagtggagccccccacacccgcacccgtactgtattgcggccgctctggaggatccacgcaacgtgg

SEQ ID NO: 2 - DNA, 2864 bp, Homo sapiens
  CDS (71)..(2830)
tttcgtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaa

SEQ ID NO: 3 - DNA, 2601 bp, Homo sapiens
  CDS (5)..(2392)
gaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgagcagtgggagacatttagtgaacgctcttcaagctcacaaactctgacccaatttgattctaacattgcaccagctgatcctgatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttaaaaaaaaaa

SEQ ID NO: 4 - DNA, 2520 bp, Homo sapiens
  CDS (5)..(2311)
gaagatggaaggcttaacgctgagcgatgcggagcagaaatactattcagatctcttctcctactgcgacattgagagcaccaagaaggtggtggtcaacgggcgggtgctggagctgttccgggccgcgcagctgccgaacgacgtggtcctacagatcatggagctttgtggtgcaacaagacttggttattttggaagaagtcagttctacattgctttgaaacttgtagctgttgcccagtctggtttccctttaagagtggaaagtataaatacagtaaaggaccttcctctgccaagatttgttgcttcaaagaatgaacaggaatctcgccatgcagcctcatattcttcagattctgaaaatcaagggtcgtattctggtgtaattcccccaccacctggcagggggcaagtgaaaaagggatccgtaagccatgatacggttcagcctcgtacatctgcagatgcacaggaacctgcatccccagtagtttcaccacagcaatccccaccaacttctccacacacatggaggaagcacagccgtcatcccagcggtgggaatagtgagaggcctctcgcgggacctgggccattttggtctccctttggtgaagcacaatcaggttcttctgctggtgatgcagtgtggtcagggcattccccacctccacctcaagaaaactgggtcagttttgcagatactccaccaaccagtactcttttaaccatgcatcctgcttctgtccaggaccagacaacagtacgaactgtagcatcagctacaactgccattgaaattcgtaggcaatccagtagttatgatgatccctggaaaataacagatgaacaaagacagtattatgtaaatcagtttaaaaccattcagcctgatctaaacggatttattccaggatctgcagctaaagagttttttacaaaatcaaaacttcctattcttgaactttctcatatttgggaactctcagactttgataaagatggtgcattgacactggatgagttttgtgctgcttttcatctggtggttgctaggaagaatggctatgatttaccagaaaaacttcctgaaagcttaatgcccaaactgattgatttggaagattcagcagatgttggggatcagccaggtgaggtaggttattcaggctctcctgctgaagctcctccaagcaagtcaccatcgatgccatcactaaaccagacatggcctgagctgaatcagagcagtgaggatactgctattgttcatccagttcccattcgtatgactccaagcaaaatccacatgcaggaaatggaacttaaaagaactggcagcgatcatacaaatcccactagcccattacttgtgaaaccatctgaccttttagaagaaaataagataaattcatcggtgaaattcgcttctggtaatactgtagcagatggttacagtagttcagactcttttacttctgacccagaacagatcgggagcaatgtaactcgtcaaaggtctcattcaggaacgtcgcctgataacactgcaccaccacctccccctccaaggccacagccctctcattctagatcatcatctttagatatgaatcggacctttacagtcaccacaggacaacaacaggctggagttgttgcccatcctcctgcagtgcctccaagaccacagccctcacaggctcctggtcctgctgtgcatcgcccagtggatgccgatggcctcataactcacactagtacctcacctcagcagataccagagcaaccaaattttgcagatttcagtcagtttgaagtatttgctgcatcaaatgtaaacgacgaacaagatgatgaagccgagaaacatccagaagtcctgccggctgaaaaagcttctgatcctgcaagttctcttcgagttgccaaaacagatagtaaaactgaagaaaagacagctgctagtgctcctgccaatgtgagcaaaggcacaacaccacttgctccaccacctaaacctgttcgaagaagattaaaatcagaagatgaattaaggccagaagttgatgaacatacacaaaagacgggtgtcttagctgctgttcttgcatcacaaccttctattcccagatctgttgggaaagataagaaagctattcaggcatcaattagacgtaataaggaaaccaacaccgttttggccagattgaatagcgaattgcagcaacaattaaaggatgttcttgaggagagaatttccctggaagttcaactggaacaacttcgaccattctctcacctataagccaattgccgttaactgtgaacatacttgtttttaagtggttttgggttcaaagccaatttggagacctagacattcagctcactgcttaactcaacattaaattttatgattctgttttgccctatatgttcaccgttgtatttaagtatcttttattttttaatttcgacaataaaaaggtcaggatggcgttaaaaaaaaaa

SEQ ID NO: 5 - DNA, 2432 bp, Homo sapiens
  CDS (373)..(1653)
ggttatacaaactcttaacaaagtgtgcctcagattttcttcttctcttttctctctgaactgaaaagggatactgggtttcctcctagcttttttttttaaacccgtcctagccagggcccacacattttaacaccctgcctgaatgggggctctttctctctgcaggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggagaccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaagcttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatctaggccagcaccaaccctggaagaagagaaaatccgaaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgt

SEQ ID NO: 6 - DNA, 2513 bp, Homo sapiens
  CDS (373)..(1734)
ggttatacaaactcttaacaaagtgtgcctcagattttcttcttctcttttctctctgaactgaaaagggatactgggtttcctcctagcttttttttttaaacccgtcctagccagggcccacacattttaacaccctgcctgaatgggggctctttctctctgcaggttcagtgaacagcattttggacaggacatttggtgccaggtctgagtagccagtttgctgaattattgtcccagtcagccaggattgtgagctgtttgggaagtttcgtggaaacgcccaagtgccagcacaggtggagggacacctggagaccagtttcaggaacttttgccacaagtataaaagacttcagaagtgcaaagatgctgaaacagatactgtcggagatgtacatagatcctgatctactggcagagctcagcgaagaacagaaacagatcctgttcttcaagatgagagaggaacagatccgacgatggaaagaaagagaagcagctatggaaagaaaggagtccctgccagtgaaacccagaccaaagaaagagaatggcaaatcggttcattggaagcttggagctgataaggaagtctgggtatgggtgatgggcgaacaccatctagataaaccctatgatgtgctctgtaatgaaattattgctgagagggcccggctgaaagcagaacaggaggcagaagagcccagaaaaactcactctgaagaattcaccaatagcttgaaaacaaaatcacagtaccatgatctgcaggctccggataaccagcagactaaagacatctggaagaaagtggcagaaaaggaggaactggagcaaggatctaggccagcaccaaccctggaagaagagaaaatccgatcactctccagttcttcaagaaatattcaacaaatgttggcagattcaatcaatcgtatgaaggcatatgcatttcaccagaagaaagaatctatgaagaaaaaacaagatgaagaaataaatcaaatagaagaagagagaacgaagcagatttgtaagagctggaaagaagactcggaatggcaggcatctctgcgaaaatccaaagcagctgatgagaagagacgctccttggctaaacaagcacgagaagactacaagaggttatccctcggggcccagaaaggaagaggcggtgagaggctgcaaagccccttgcgtgttccgcagaaaccagaaagacctccccttccacccaagcctcagttcctaaactcaggggcatatcctcaaaaacctcttagaaatcagggagtggtgaggacactgtccagctctgcccaagaggacatcatccggtggtttaaagaggagcagctaccacttcgagcgggctaccagaaaacctcagacaccatagccccctggttccatggaattctcacactcaagaaagcaaatgaacttcttctgagcacaggcatgcccggcagttttctcatccgagtcagtgaaaggatcaaaggctatgccctgtcctatctgtcggaggacggctgtaaacatttcctcatcgatgcctctgcagacgcctacagcttcctgggcgtggaccagctacagcatgccaccttggcggatttggtggaatatcacaaggaggaacccatcacttccctggggaaggagctccttctctatccctgtggtcagcaggaccagctgcctgactacctggagctgtttgagtgacagcctccatcagggtcatcctacagcctccaagcgggctttcccctggacaaatgccactgcaacatttatgtgtgaagccaaaatcaccctgcagcagagccaatactgatcaactgaaagtaaagtatccatggagtcctcattgacacctcttttctgcacaaatactggaattcaatgtcaagagaaaatgacctctgctcaaaagggagaagagtctcaatttcagcaagtacctgtcatgaagggtatgaccttaatgatgtacataaaataaaacaaatgaagaaatggaaaacttttagaaattaaggtgtacttgaaaacgaatatctatcatatgacccctgcactccctctgtatcatctcaggaggtttcaggggcctgttgacatgaagtttcgaagtttcatgttggctttggaatggtagcaaaagcctttcctggctgagatgatgcttaaaacacacctcacttattgtacatgttggaaccaggacatgagagacatagaaaaacagaagtcatgaatgtaaattgaatgagaggcttaacatgcatgaaaatacagatggacctgcaggaaagtgagcaaacatcgctgagtttgttttcttgttcgggagaatggggccggggctggcctggcctcccctggatatactctatagtgcaccaaaaggataaagcatctgtacatgtatttttttattttttatcagaagtgcttagacaagaacagaataagcaggctgtttggatgctacttgt

SEQ ID NO: 7 - DNA, 1838 bp, Homo sapiens
  CDS (227)..(1519)
agcctggagcctgcccagcggccaccactcatccacatcatggcacagcccctctgcatccgtgccctcctcaacctccacaccgacgtgggcagtgtccgcatgcggaggcctgtgcagggacagcgagcggtcctgggcggcagggtgtgggcacccagtgggagcacaggaggtctgaggcagagggaaacctggggcaagtcctcccttcctgcatgtaggaatgtcaggagggtctttgtccttatgcccccatctgtcctgcagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcaaaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaagg

SEQ ID NO: 8 - DNA, 998 bp, Homo sapiens
  CDS (87)..(248)
gcgcgcttttgaatacctgcgttctgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccggcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgcaaaaaaaaaaaa

SEQ ID NO: 9 - DNA, 1198 bp, Homo sapiens
  CDS (430)..(1107)
ccgtatgaagttctggtgcccccttttccttctgccatgattctaacgtgcgtccagagagctgtgagtgtgctctactaccgttgggaaaaccgaaattgcggaggcctgaggcttttcaaaattgaacgggaagcgtttttaaactgccgcagggagaggcgtttgcgagatccgcgctcgctgcaacacctactcctccctcggctctgggagtcgccaggccagaggcgccgcggacctggtgcgcagcgcactgcgcggctggcgaacgggcaggccgggcatcagcgcaggcgcgcgcggctggggctcggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagggtcaactggatggctgaaggaccatgggtaggagagaaccttttcaatgtatatccttttgaatcttgaattcaaaaacatattaaaaatacattttaaagcatgtcatgtgtaagtta

SEQ ID NO: 10 - DNA, 933 bp, Homo sapiens
  CDS (165)..(674)
ggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggtgagctggggcaagatgggacagagccggtggtctccagcatagggagggatttcactcttcttcccaggttcttctgaagcacccacacaaaatgcacactctgcgatatgtagtattgtcattatttccttcttctacatcaggtagtggaggctcagacaagttatttagccattcacctagagagtaagtgttgaagccagagccacctccaactctggagcctaccaagagaactgtggggatgtgggatgtggcgggacagggttgctgggtacagaagccagacttcttttac

SEQ ID NO: 11 - DNA, 811 bp, Homo sapiens
  CDS (385)..(633)
ctttgcttcccttctctctctcaaaatatcttaatattcttttactgcagttgacacaagtaactgaaacgaggaaagctaaacgacgattaaggagggagtgctggactcacaaatccctagagacagggcccatgccacaggggacacatggggaagcgccagggtcagtgaaggggagagggatgtggggaaacactgccaagagcctccatggtgttttccacaggaaggaaggtgcagcaggatgagcaggattaggataagtagctagtctgaatcattacagacggcgctaggaggtaggggctgtccctaattgtcttgtacctagccctagggtgaccagggcaggggaatcatggcgagaagcgtaagggcctgatgaagaaggtgtgctgggtgtgggctctagcccacttggttttgtgtgagaggtggctgacagcaggttgtttgctgtatgtaggagttatccagccctgcaagggcagtccctccagtgtctgcaaagcccgaagatgtctgcatccaaaatacagaataaaaagatatggttactacaagtactcagtaagactgataatctgtcatcatcatcctcatgcccttaaagcagagctaactgatgattaatatatgcttctatgttaacagtcttggactttattaatggtgggtggaagttaacttaatgtgtgtatgcaaactaaaaagtggcatccttttcattaatgacccaaccattattcaagagctatgtctagttagggacttcagacttttgaaagaaatgaagaaataatgccag

SEQ ID NO: 12 - DNA, 1478 bp, Homo sapiens
  CDS (54)..(266)
gcacgaggggcttgcgacggaagtggcctctctgcttctgcaggctggggaagatgctgcgtccattaccgtggctgtaccttggcctctgcagcctcctggtgggggaggcagaggccccgagccccgtggatccgctggagcgaagccggccgtacgcggtgctgcgagggcagaacctggtgttgatgggaaccattttcagcatcctgctggtgactgtcatccttatggcattttgtgtctacaagcccattcggcgtcggtgacagccagacaagttcttcaatgagtatttgggaataggataagttgtgttgcacacaggccagtggagaagttggaaccaaaactttcctacttggaaatgacctttggtctggacagttggtaaatgctaaatgaattagaagaaaacatgtactagacattattttttcctaacactgtagcgcaaataattggcccctgagtccgcttctcagtgtttctgactgtacttgttaaaagtaagacctgaaagctccaaaggtcagtgtaaagatggagtgttcatgagaaagaaaacatggtaaccttgtgagtgcctgtaagaaccacactgtaaagaactcatcattaatgcttgaaaatgttattaagaaggagacttaccatgcagacattccctatttaagaaccatttggttacagtgggttaagaatcacagattttttttttttaatctcacctgagttagcctagaatgcgctggttgcaaagtggtgtcagctgtggggatcttgggccctcgttcctcacctgcatcctgccctgcactcaggtgctccccctgaagtcagggtcacatcaggtagacctgttactatatgcacctttggcctggaatgctctgaagttggactggaaatgttactaggttggcctgttacaaaaaggaccccatcctgcttaaacacattgatctcccttgccctgcatttgagtctttctagcccacggtctgaaacttgaggcagctttccagatttggaatgtaaaaggctcagtgggcactctgttcatccctgggtggggagggcccagccaacagaagtgcatgtccactgtgcgggccagtgtgtgtttacacaaatttcatctcagctttgaaaatgctgctattagtttccactgttggtgaactggattttttcctcctattgaaatgatactttcatacttataaagctgtcgtcaatatttatttcaaggtgctagatttaattttgttattaaattgaaatgcttatcttgtgttcaagcacagcactgattttaacaacctgcatttaatgtgaagtaaccgaagtaggatactgtaactgtgtaaggattttgtttgtaatcttgtaacattgaaccattgaaatgttcagttctttgcttttgagcaaaacgtcaattaaaactaaagtaaaatcctaaaaaaaaaaaa

SEQ ID NO: 13 - DNA, 563 bp, Homo sapiens
  CDS (60)..(398)
gcggtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcaaaaaaaaaaaaaaaaa

SEQ ID NO: 14 - DNA, 633 bp, Homo sapiens
  CDS (118)..(483)
  misc_feature (1)...(633): n = a,t,c or g
gttcctctgggtgcttccgcctccccttctgctgcttctccagcctcttcggcctcctcgcccgccgcgggaacccgagaccccagtgtatgccccacccctgaccccgctcgcgacatgtccaccccggctcggcggcgcttcatgcgggacttcaagaggttgcaggaggatcctccagccggagtcagcggggctccgtccgagaacaacataatggtgtggaacgcggtcattttcgggcctgaagggaccccgtttgaggatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttggtgctgtttccatctttccnttgccaagttttccta

SEQ ID NO: 15 - DNA, 944 bp, Homo sapiens
  CDS (384)..(794)
  misc_feature (1)...(944): n = a,t,c or g
tgttatatgaaaccattggttttgaacaggactctggctactatgtggaaaagagtggaagcaacgagagcaagagactattgtgccaatccagaaaaaggaatggaggtggtaagaagcagtcagatcctgcatacattttcacgaaagcacctgcaggatttcctgatggactggacagatgtaaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttggtgctgtttccatctttccnttgccaagttttccta

SEQ ID NO: 16 - DNA, 1184 bp, Homo sapiens
  CDS (23)..(235)
tgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatccttaaaaaaaaaa

SEQ ID NO: 17 - DNA, 1973 bp, Homo sapiens
  CDS (148)..(1839)
ggcagccctagaaggagagagagaaaggagccggcagcgctcttacgcgtcccggggctgccgccactctctcggccggtaacgcggtgctttgcggctgtcgtcaagcgcggcgttgggccggcgggagggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatgtctacgttggtattccgcgtgcatctggatacaaatctatactaaatcctgagtggactgtacttgttcgagagtcccaggtaattgtcattccataccctgacaatgtccctcgaagctggagtgcgcacactgtatcgtacaccaagtaatagtgcgctgattactgctatagctctgatcgacgtctgtggtggcatcttggcaatacctggcattgtacattggcaggacaagaacgcagatgatagacgacgactgcgagactccgaccgatttgatt

SEQ ID NO: 18 - DNA, 2356 bp, Homo sapiens
  CDS (1)..(1641)
atgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaaaaaaa

SEQ ID NO: 19 - DNA, 703 bp, Homo sapiens
  CDS (2)..(430)
gatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcaaaaaaaaaa

SEQ ID NO: 20 - DNA, 3671 bp, Homo sapiens
  CDS (135)..(3557)
aaaagttgttttgtaggatacaggagagttctcaggtactttataaattggagcagagtaaatccaaacgtgaaccagagaatgagttaaccaaacagcacccttctgtttctttacagcagtataagaatttcatgtcatccatttgcaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacactttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaataggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccctcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggactgggatgggggtatgtgtggatttttcctccactaaatctgcaggaaacatgttgaacataaattcaaaaattttatcccaaaaaaaaaaaaaaa

SEQ ID NO: 21 - DNA, 3893 bp, Homo sapiens
  CDS (135)..(3779)
aaaagttgttttgtaggatacaggagagttctcaggtactttataaattggagcagagtaaatccaaacgtgaaccagagaatgagttaaccaaacagcacccttctgtttctttacagcagtataagaatttcatgtcatccatttgcaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacactttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaataggatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccctcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggactgggatgggggtatgtgtggatttttcctccactaaatctgcaggaaacatgttgaacataaattcaaaaattttatcccaaaaaaaaaaaaaaa

SEQ ID NO: 22 - DNA, 779 bp, Homo sapiens
  CDS (375)..(695)
atatcttttttttttttttttttttttcagagtgctagggctttattacaaatggagttgactgctagagagacccttctccaatctttcttctgtaccttcttccctcccaaagacatccctctaggggaggtcagtaggccattaggtaggaggaaatctggagagtgaaaaggggccttgcttttgtcaaagtcctctgaaacaaccactgagtctgaaggctggctccagttgagaatcttctagtggaagaggtttagctctcatcttcaaggtccttcatttctacatcctggggggcttttgtcttcttttgccttttgagctgtggttcactagtcctggctggctttgaaggggcttccacttccatggctgtcttctctttctgggcaagccggatctgctggaggagttttctgcgcttcttccctgacagtgtaatgttggcacgtgcactggacgcccgcttcttgaggtggtgccgcgtgatcagcccttggtctatcacagccccgaccacccggtgcctcagacgccgctcccgattcaacacccgccggcgtttgaacagcttcttcttcagctcctgccggggagaaagatgcgaatcagatggagtgggctcgccgcgacccggggcccctccaccaggcagccccggcccctcactgatcccatctcgtgcgagataaaagggctcaggaacgcttgaggaaacaaagtcgcggcccccacacagtcaccgttcggggccggttgatctttccacgaaa

SEQ ID NO: 23 - DNA, 5761 bp, Homo sapiens
  CDS (163)..(5148)
acctttccattcagtcgcccaacatggctggagcgcggcggaggtgagccggccgcccgcccgcagacgccccagcctactgcgccagagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctacaatgaagaggtccttgacttatttgataccactcgtgatattgatgcaaaaagtaaaaaatcaaatataagaattcatgaagattcaactggaggaatttatactgtgggcgttacaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagtcccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaaacaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcaattgaagaaattgcagcaggatgtgatggaaatgaaaaaaacaaaggttcgcctaatgaaacaaatgaaagaagaacaagagaaagccagactgactgagtctagaagaaacagagagattgctcagttgaaaaaggatcaacgtaaaagagatcatcaacttagacttctggaagcccaaaaaagaaaccaagaagtggttctacgtcgcaaaactgaagaggttacggctcttcgtcggcaagtaagacccatgtcagataaagtggctgggaaagttactcggaagctgagttcatctgatgcacctgctcaggacacaggttccagtgcagctgctgtcgaaacagatgcatcaaggacaggagcccagcagaaaatgagaattcctgtggcgagagtccaggccttaccaacgccggcaacaaatggaaacaggaaaaaatatcagaggaaaggattgactggccgagtgtttatttccaagacagctcgcatgaagtggcagctccttgagcgcagggtcacagacatcatcatgcagaagatgaccatttccaacatggaggcagatatgaatagactcctcaagcaacgggaggaactcacaaaaagacgagagaaactttcaaaaagaagggagaagatagtcaaggagaatggagagggagataaaaatgtggctaatatcaatgaagagatggagtcactgactgctaatatcgattacatcaatgacagtatttctgattgtcaggccaacataatgcagatggaagaagcaaaggaagaaggtgagacattggatgttactgcagtcattaatgcctgcacccttacagaagcccgatacctgctagatcacttcctgtcaatgggcatcaataagggtcttcaggctgcccagaaagaggctcaaattaaagtactggaaggtcgactcaaacaaacagaaataaccagtgctacccaaaaccagctcttattccatatgttgaaagagaaggcagaattaaatcctgagctagatgctttactaggccatgctttacaagatctagatagcgtaccattagaaaatgtagaggatagtactgatgaggatgctcctttaaacagcccaggatcagaaggaagcacgctgtcttcagatctcatgaagctttgtggtgaagtgaaacctaagaacaaggcccgaaggagaaccaccactcagatggaattgctgtatgcagatagcagtgaactagcttcagacactagtacaggagatgcctccttgcctggccctctcacacctgttgcagaagggcaagagattggaatgaatacagagacaagtggtacttctgctagggaaaaagagctctctcccccacctggcttaccttctaagataggcagcatttccaggcagtcatctctatcagaaaaaaaaattccagagccttctcctgtaacaaggagaaaggcatatgagaaagcagaaaaatcaaaggccaaggaacaaaagcactcagattctggaacttcagaggctagtctttcacctccttcttccccaccaagccggccccgtaatgaactgaatgtttttaatcgtcttactgtttctcagggaaacacatcagttcagcaggataagtctgatgaaagtgactcctctctctcggaggtacacagcagatcctccagaaggggcataatcaacccatttcctgcttcaaaaggaatcagagcttttccacttcagtgtattcacatagctgaagggcatacaaaagctgtgctctgtgtggattctactgatgatctcctcttcactggatcaaaagatcgtacttgtaaagtatggaatctggtgactgggcaggaaataatgtcactggggggtcatcccaacaatgtcgtgtctgtaaaatactgtaattataccagtttggtcttcactgtatcaacatcttatattaaggtgtgggatatcagagattcagcaaagtgcattcgaacactaacgtcttcaggtcaagttactcttggagatgcttgttctgcaagtaccagtcgaacagtagctattccttctggagagaaccagatcaatcaaattgccctaaacccaactggcaccttcctctatgctgcttctggaaatgctgtcaggatgtgggatcttaaaaggtttcagtctacaggaaagttaacaggacacctaggccctgttatgtgccttactgtggatcagatttccagtggacaagatctaatcatcactggctccaaggatcattacatcaaaatgtttgatgttacagaaggagctcttgggactgtgagtcccacccacaattttgaaccccctcattatgatggcatagaagcactaaccattcaaggggataacctatttagtgggtctagagataatggaatcaagaaatgggacttaactcaaaaagaccttcttcagcaagttccaaatgcacataaggattgggtctgtgccctgggagtggtgccagaccacccagttttgctcagtggctgcagagggggcattttgaaagtctggaacatggatacttttatgccagtgggagagatgaagggtcatgatagtcctatcaatgccatatgtgttaattccacccacatttttactgcagctgatgatcgaactgtgagaatttggaaggctcgcaatttgcaagatggtcagatctctgacacaggagatctgggggaagatattgccagtaattaaacatgaatgaagataggttgtaaactgaatgctgtgataatactctgtattctttatggaaaatgttgtcctgtacttactaggcaaaacgtatgaatcggattaactggaaaatatatctgaattcaactgctgactataaatggtattctaataaaattgtgtactatcctgtgtgcttagttttaagatcaaccaatagatatatatcctacaattgatatattgctttattcacacttttattgtggctgaatttttgtgcctatctataaaacacactttcaaattatttgaattaccaagacgtctgcttttgtgacagtcagaaaacacacctggaatacgatgcagcccaccattaactcattcatgtagtttattcaagtgatttatgtatttaaactaaatattgaaaatgttagtcaaattgtggtttgcttgtcaggtatttatatcagtctgtagtggattcccaaatttcaaagctcttttaatgtaatggacaaaaataagatatgagaatattattgatgaattttcataaggtggaattgatcttaatctactaacagagaagggtagacagtttgtgttaaatgttggcatt

SEQ ID NO: 24 - DNA, 1361 bp, Homo sapiens
  CDS (376)..(471)
ggcttaactgactatagagagtggctgtaagttctggggcaaagcttgattgtattttcagtgatgtatagttacattgtttcatgttaaaatcatcgtgcatggaaagtgaaatgtgcgtatgattttaaattattgtaatatgtactatacccttcccctaaacttctttcattgatgatacacagaattcctctatttttgcttgaaaatagtcctttagattggagtagccttttcttagatccctctatggttccatgagatgaggtgatacctgcaaagcacttttaaagatatttttttaggctaatgtccaagatacagcattgaggaggcagctatgtctaatgagggctctcttgtttgctagagatgagagaaatgtatactaatcattttaatttgtacttaaaatacattttactaatcatattgattttaaatatgacaaattcttctagtagatactaatctttcttgtttatcatattgtcctagagaagcctaggtaaaaatgggttccacctagtctgtttgtataacaccttcccccgtcccctctccatccctgccaattgggctctatgcatattgacaagcaaataagaaaaccttaggtttcttgtatttgaatttccaaaacaataaaaggttttgactcaagatttgcattcaagaagaggcagaaattttgtcttatctttttatcattttgtgaacttgtgtttctctgtatgcttagaaaattttacacacaaggaatgtttgaaaaagtgagaattttagagtgcttgggtggtttttatttggtcagtgctgatgtgttaggtgtttagggaaataatgcttcaggacctttttgacaacacagcttcatgaatgactgggggatatttatgtttgtgctgagaaaagggagggagtgggcaggttggagtggggacctttccattgaaagcagtgcagtcagctgtttcgtagatgcattttttctttatgcttgtaacattgttcttgtgtccataattgactgaaatgtcaagctccaggaatgcaaggcatttatcaggtgaccagaagtagaaccttgttgattatgaaatggaagaataatgtcaaggtagtgggggtaaaatgacaaataagattttactggtgaatttccatgcttagtatgtacattaacctctttttaagttgcatgttaatctggtataacgtattgtgtctggtttatgctttgagtaaaaaggaaaaaaaaagacttgagttacaattgttactctattatgtactattacatataccttttcttttagaaagggttaattataattactattcacaaaaaaaaaaaa

SEQ ID NO: 25 - DNA, 556 bp, Homo sapiens
  CDS (133)..(501)
aatgaatttaaatcccttgatgttcccatttaacagataggaaaacgggggcagggagaagaggaactgtaactcccagtttccttccccttgcacccagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgggtgaggccaaagatggcagcaacctctgcttcagcaaatgattgtgtaaccctggggcacttgtccctctctggacctgattcaccgatttgg

SEQ ID NO: 26 - DNA, 477 bp, Homo sapiens
  CDS (8)..(250)
gggagacatgttccattttggtctgtgggatctgcatttcttccttatagttatggctcatagagatgactgctctttcaaaggtggttgtggtctattagagcgtttccaatgtccccatacttctttctcgagtgctagtcaaaagcgacttgcagatggtatggaatgtctttgtgagatagaaagaacacagactaggatcagaaaaatctgcctcccaaccctccatggccatcttctggctgtgtgactttaccgccctaactctttaaaatagccccacacctacctgccaggattgtcttcagaattacataaaataacacataccaaagtctctagaatagagcatgtcacataatagactcaacaaaggtcagcatctcttctttctttttgggatgactaaagtagcctaaataaataagtattcgcaatgcatgacttgataacataaacttttgtaatactcta

SEQ ID NO: 27 - DNA, 3043 bp, Homo sapiens
  CDS (215)..(1615)
aagcttgcggccgcaggggccagacccggaacggctccagagcctccagaagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctagatatgatctatgtctctggaggctttgatggaagcaggcgtcacaccagtatggagcgctatgatccaaacattgaccagtggagcatgctgggagatatgcagacagcccgggaaggtgccggactcgtagtgtccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgatgattgtacttatttgacacatactccccgtcgtcctggttcttgttcctgagaagggtgggtaaatattccaggaaaaagaatgcacattgaatggatgtgagagaccacattgcctctcccactgctttggggagcactttcctgtcatttctaacttaccacatgcttggtgtactatatgtatgttgtgcctcatatgttgcaaagaactaaggtgagtatagcctactagatatgggcaatatccagcctagatgattggaaagataccagtttaagtaaacttggtaaaatccaagtcttttttttttttttttttcccaggaacaactacattttctcatatacaggtagctaggggcaacacagtcccattctagagggaaacaaaagggagagccccacaaaactttggggacaagggagagagagactcatctgacacttcttttggaggtcaggatttgtatatcagaattgaagttagaattaagtgaattaaactgaatttgattgtgagtgaacctagaacagcactgaagtattacataacctggaagactgagaagggtatattatttgaaggatctttttatttccccgaggtctttcgcactggagacagcataaaagagtgaacaaatgttgggatgagagaagatgacatcaatgtgggagttcagtataactggggataaactagaagaacctgtgattttacagtcatcttattacctgccagggctcatctagccatggcaatgtttgccttgaatgggggtgaaagcctttctttgttggatcaaatactactacactattacacttccacactatttatttggggatgggctgggagtgacagtagcctagtagttcagctacctgattactgccccattcttttagaagcacatgtctgccaaggagtggtttgtactgctgtgtttggtacatctagtcttttttctgctataagttttccttacctgtcctttagtgtagattttattcatcacaggacagaataatcaaggacaaccaaaatccttttgttagtttcagtacctcagctatcaacatttctgagctaccattcaatgttcctctgtgtcatggagtgaaattcttgttttgtgggtattaggagtgtgggaatgtgataacctaaacaacctttgctctgaaattccatttttccctctttccctgagttgtattgacctacagagttaatttcctttgtatttttttaagaaaatattaaaaatcaacggtctcaaaaaaaaaaaa

SEQ ID NO: 28 - DNA, 1129 bp, Homo sapiens
  CDS (289)..(828)
ggagtggggccccgaaatctgagggtgatcgtagtcactagttgtggcccccatgcaggagcggagagcgggttctggtttctgaaacctcgagggatgggagagtatctgggccgggtggacggaggcagggagatggagagcgctagacaccccattttagagtgcagatggatcccgcttaaggcaacaaaaaaaagcctggtttatgtgtcgacgctttgatgcttttgagtcgtgaggcggtctggctttttgttttgtttgtttgttttgtttttatcttccatgaacagcgcttccgtggatgggcatctcagtggttgtcgtctttttctcttcctttcacctcttttcaggttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggtcctcctcctcctgggatgatgccagtgggacctgctcctggaatgaggccgcccatgggaggccatatgccaatgatgcctgggcccccaatgatgagacctcctgcccgtcccatgatggtgcccactcggcccggaatgactcgaccagacagataaggatagaggggaggccttattgtatcggttttatattacctgttctgcttcaccaggagatcatgctgctgtgatactgagttttctaaacagcataaggaagacttgctcccctgtcctatgaaagagaatagttttggaggggagaagtgggacaaaaaagatgcagttttcctttgtattgggaaatgtgaaaataaaattgtcaactctttcagttaaaagtgtgttccctttttcctcctctctgtgttctctgtgtattataaaagaaatgaaacattccaaaaaaaaaaaa

SEQ ID NO: 29 - DNA, 5843 bp, Homo sapiens
  CDS (1)..(5415)
atgtcggataccaaggtaaaagttgccgtccgggtccggcccatgaaccgacgagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaggcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagctcaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtggccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatgagtatgtctaactgtatgtcaaccccagaggcccttcaccgcaacaacttggtaggaaagatgcatccagttgtttgtgacagcaaagatgagcccacagagaagcaggctcacttcctgcacagctgtctctgtcggagagcaagtctgttttgggaactagaacgcaattgtgaaattataagaccagtggatttttttacctggcacatgggttggtgttgaatgaagtgttcagatggataaggatcaatctcatattcattccctgggatgtttagttaccagttttcccaaagtgttctggtagcatctaccatatttcatcaaatctgtgattcctttgattattatatgaaccattattttatgtatcattaagaaaaaatactgccaattaaactctgtcatatcaaaaaaaaaaaa

SEQ ID NO: 30 - DNA, 3906 bp, Homo sapiens
  CDS (1851)..(2123)
tttttttttttttgtcatattaaaaggtgctttatttcattaggcactggaaaatgcaaattaaaaccacaatgctataccagtacacacgtacagacaggcaggcaatattagatattcacattggtgggtgggtgaattggtacaaactgcaatgtctactaaaactaaaaatatgcataccttataagccagcaactctatttctaggtataaatagccaacagaaagccaggtatatgcttaccaaaagacctgaatgtttatagcaacactcttcttagcatccacagtgagaactacccaaatgcccaagaacagtaaaatggataaacaaattgtgttacagtcgtacaatgggcatttagaataaacaatatagaaaaatctcaggaaaatattgagtgaaggaagcagacacaaaggattcaatactgtctgatcccatttatgtgaagttaaaaaacaagtgaaactatgctgtcagaatatagaatagtggttatcactgcagagaaggtgactgaaaaggggattgggaggctggtgggggtgtgtaaaggcctgtttcttattctggaggctagttagatgagttcaatttgtgaacagtcaccaagctgtaggtggacaatttgtgcacttttctgtatcacgctttaataaaccatgtttaaaatcatataggggcatcttggtttcctcccctgaggtgccagtgacatatccagtacctcgaagtccccatcccatgctaagtgaaacgtgctttctcaacacacagctgcaatctctacatttaaagatactgaaactgatatagcgggttctctggctcctggaaaagataagtctactacaaagaaactaggcaaaactttaaataatatgataacagctatcttcccctaaatgttatagagttaataatgtaccttattgtgacttatacaatagaacgtatttgtatagtattgtaatgccagttaagttgtagcatcattatgacaccaatcatttacaatttaaaggaaaataaaatattttaattgattatgggctctttaaaagccaaaaattattaaacccttcaaactagaaaagaccactgaaacatcctacaggttttaatttccaataaagtaaatactgataactataacccacataaaaagctctttggggtcctcaataattagttttagagtaaaaagttcttgagaccaaaatgtgagaaaaccacgtgaattaatcccagccttgttattagatttatttcttcctatgccctcataaggaagcattgctttggaattccaagatgtatgtaattccctggcttggctgaggttgccagttctagttctttattctttttactcaatttttcctttcagtttgttgctttttcttactttttgtccagcattgtgctttaattccattatagagatccattcttcaggtgaactatgcaagtgattttcttttcaagtgatttgaaccaagcgtcttaccagtttttcccgaaattaagctgacctgggacaccttgactccaagcccagcagtaagtctcacatgccacagggcctctcagccatctctgctgagaagggacccttactggcagctaggatccttgagaccatcgtcaagggcaacctggctaaggtaaggttggcctgggacctcttaactgggaaagcagcagctgtgaagttcattgatgagactcagcagatctcctccagacaccatccacaaagtaggaaccatgaaggctcggatcaccccaacatagtgaaacatttgctgtgatcgatattgaggaatctctttgctttgtcatgaagcacactagccaggaggagaagtttgtgaatacctgctcatggcagcaggaaagaaaaaaaaggactgaagcaaattctaccaaaagtgtctgctgtgcaagctgtcaccagaaacgtattgtccacagagatttaaaggcagaaaacacgctcttggatgttaacacaaacatcaagattgcaaattctggcttcagcaacaaattcagcttttacaaactggataccttctgtggcagtcacctctggtcagcagatccctgtttttgatggacagaatttcaaggagctgcaggaggggaactgagtagaatatattcccttctacatgtccattgagtataaaaacctgctcaaaaaatgtatccttctcaatcccagcaagagaggcccttcagagcacattgtgatggatccatgaatgattaggaagcatgaacaggaacttaagccccggacctccgccatactgaatcatggcgtccatgggttacggacaggaaagatccaggactccctgtgaagtgtgatgaagcagcgatcgcctacctgcttgtgggttctaagagatccgaactgtaaggttaccccatcacctaaaacccccactgtcagctgatctgacccacagtggtgcgccttccctataccagggtctctgccagccccgagcagcagcgtttcagcaacctgcctttcccatctttcacggcctctctaagaagactcagaggagccacaaagatcctaagcgggatcaagagacagagcagaaaggcagcactgcgcccgccagccccgtactcgcctggaggggacgaaccccgccccctctgtgaatagcgacctcttaccaaaaccaaaaaagagcaggaattcctcactcggggcaaaagccagtttggccagacctccacgcagaacgacaacagcagccccacagcgctgggcctggggcctcctgggttcctgcctctcaccccccgccttcgtctccccggccaccagcccgggaatcccagtcggtctccttgcagcccaaccaggtctcggtgtcgtaccccacggagagcagctggggggtgcccgccaggtacagctccccagagtgcccctgatacctcccttccacccgcgtcatcagcgcagggggcagagcagagcccccgatgggacaaggtacgcgcggcctggcagcccgacaggtgacggccccggaaatgcggcccaaccgggtgaccccagcctctccctcaaacaaaggccgcagacagcagggggccgccgggagcttcttcagcaagttcaggttcaagttcacaagctggactcttagctgcgggtttgcccaaaggaacctgaaagaacctgaaagcaaagacgggggaggacactccgacctcacatgggggcagcagaggcagtgatttaaaaatggctttccagagacccagccgcgctccctgcccttgaggcggaggctggaggtcgcgagtcggtggagccccgctcggtgctgcggagactgcagtggcggctgggacccggagccgtgggcgaggccggcgcgaagaactaagggaggactcaggcgacaactccagcagcctctccactttggtcccccgaagcgccggtccagaagctcctcggcctccacgagcgtcgccacccaggtcaccacgcctgggggccgagaggttcagctgctcgcacccgggccccgcatcttggtcccgagcgtcttccccgggccttctcccctctcttgccggtctccgccttcccttccgccttcctgcgcttttgtgtttcagctagtttgagatgactttctgtgtcacttgtacccaacagagtcgcataggtcactttatctttggggaaagttcatccttttctagctgagtcacactgcccttttaatatcctgagatacatgctgaactacaatactattgacacgttttatgttcaatagtagaatggatggaggaagagaaagaaaatgaaccagtattatatttgcaaaatgaaaatcaatccttct

SEQ ID NO: 31 - DNA, 1010 bp, Homo sapiens
  CDS (16)..(924)
attcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaagatcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcaggggggagcttgtaggaggcctcacctgcctcacagccccagaccactccctgtccagcacagccctccagtgacaccctgttggaccagtacatcagagagcacgcgagaaggatctgtcatggtcggcatgggaagcagatctgacactgttccgactcgtaggcagctgttaagccagctgggcataaatacctctgggttattgggggcccccaatggccttggcacgaccggggccgggacgggttgcgacatggtcccagatggattggcgttagcgcctgcgaagaggtcctaagttagcaccggtcgtatcccacggaggaggagatcctcccgcgaaagaaaagtgccgccttattcctgccgcccggcgcaaca

SEQ ID NO: 32 - DNA, 3075 bp, Homo sapiens
  CDS (433)..(1893)
ccccttgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatatatttattgagtgtctactgggtgccaggctctatatctatgtgcatagaaaaaccctggaaggccatacaacaatatatatagagtgatcgtctctgcttgctgagctaacaggggtgtcaagcttccattttggtatctacttctaaatacactcagaacaggagaaatttggactaattttcaaactacagacactttctaatcatgatgcatttcaaaagtggactcgaattaactgagttgcaaaacatgacagtgcccgaggatgataacattagcaatgactccaatgatttcaccgaagtagaaaatggtcagataaatagcaagtttatttctgatcgtgaaagtagaagaagtctcacaaacagccatttggaaaaaaagaagtgtgatgagtatattccaggtacaacctccttaggcatgtctgtttttaacctaagcaacgccattatgggcagtgggattttgggactcgcctttgccctggcaaacactggaatcctactttttctggtacttttgacttcagtgacattgctgtctatatattcaataaacctcctattgatctgttcaaaagaaacaggctgcatggtgtatgaaaagctgggggaacaagtctttggcaccacagggaagttcgtaatctttggagccacctctctacagaacactggagcaatgctgagctacctcttcatcgtaaaaaatgaactaccctctgccataaagtttctaatgggaaaggaagagacattttcagcctggtacgtggatggccgcgttctggtggtgatagttacctttggcataattctccctctgtgtctcttgaagaacttagggtatcttggctatactagtggattttccttgagctgtatggtttttttcctaattgtggttatttacaagaaatttcaaattccctgcattgttccagagctaaattcaacaataagtgctaattcaacaaatgctgacacgtgtacgccaaaatatgttaccttcaattcaaagaccgtgtatgctttacccaccattgcatttgcatttgtttgccacccgtcagtcctgccaatttacagtgagcttaaagaccgatcacagaaaaaaatgcagatggtttcaaacatctcctttttcgccatgtttgttatgtacttcttgactgccatttttggctacttgacattctatgacaacgtgcagtccgacctccttcacaaatatcagagtaaagatgacattctcatcctgacagtgcggctggctgtcattgttgctgtgatcctcacagtgccggtgttatttttcacggttcgttcatctttatttgaactggctaagaaaacaaagtttaatttatgtcgtcataccgtggttacctgcatactcttggttgttatcaacttgttggtgatcttcataccctccatgaaggatatttttggagtcgtaggagttacatctgctaacatgcttattttcattcttccttcatctctttatttaaaaatcacagaccaggatggagataaaggaactcaaagaatttgggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaattttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaa

SEQ ID NO: 33 - DNA, 793 bp, Homo sapiens
  CDS (60)..(338)
ccaacaaacccgctgaggagtacgctgccgctcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaa

SEQ ID NO: 34 - DNA, 3448 bp, Homo sapiens
  CDS (415)..(2991)
tatgaatgcacagcttgcccatcggggacatacaaacctgaagcctcaccaggaggaatcagcagttgcattccatgtcccgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaggtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggtaagatgtttccagtcttcctatgttgtcttaaaatcttgtaaaccaccacaaattagtacatttcttaacatatatattaatgtgaatttttggattttattactgtatggtgattatgtaagagaaagtcctcattttctgaggaaatacacactgaggggtttggggtaaaagggcatgcaggtctgcaatttactctcaaatggttcagcaaaaaataatttgtgtatgtggtgtgtgtgtgtaaaggcaaactttcaagaaggaactggagacaaatcatgtaatatgatattgcaaacagatgtacaataatatggtttaaaagtgtatgcttaatttctaaagagtaaatccaagaaagtgtccagtgaaggaaaaaggcaagatcaaagaaacaggcaagttttgaatggaatttactagctttatttcttaacattatctcaattagatgtctattaccaaacttaatttcaacaaaaagtaagattt

SEQ ID NO: 35 - DNA, 707 bp, Homo sapiens
  CDS (8)..(601)
ctcagtcatgccagtgcctgctctgtgcctgctctgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggcccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgtgatcagcc

SEQ ID NO: 36 - DNA, 708 bp, Homo sapiens
  CDS (8)..(439)
ctcagtcatgccagtgcctgctctgtgcctgctctgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttttgagcacagagcagagacagacgcaggcggggacaaaggcagaggatgtagccccattggggaggggtggaggaaggacatgtaccctttcatgcctacacacccctcattaaagcagagtcgtggcatctcaaaaaaaaaaa

SEQ ID NO: 37 - DNA, 1647 bp, Homo sapiens
  CDS (153)..(1298)
gtgaagaaggcgggaagttaatcctcttccaatcagctccccatctcgccctctggcggctccggaccacaggccgagttactctgattaccgccatgctccaagacccgcactgacagtccccacgtgagggaccgcggtgggagtcctaaatgggggaggaggggacgggcggcactgtgcatctgctgtgcctcgcggcctccagcggggtccccctattctgcaggagcagtcgcggcggcgcccccgcccgtcagcagctcccgttctctgtcatcggttccctcaatggagtccacatgtttgggcagaatctggaggtgcagctgagctctgcgaggaccgagaacacgactgtggtccttcttgtgggacttgaagaactgaccaatatccgcaacgtggagagactgaagaaggacttgagggccagttattgcctcatcgacagcttcctgggggactcggagctcatcggggacctgacccagtgtgtggactgcgtgattcctccagaggggtccctcttgcaggaagccctctccgggttcgctgaggccgcgggcacgaccttcgtcagtctggtggtgtccggccgggtggtggcagcaacagagggttggtggcggctggggacgcccgaggccgtgctgctcccctggctggtggggtccctgccgccgcagaccgctcgcgactacccggtgtacctgccgcacgggagccccacggtcccacaccggctcctgaccctgactctgctgccgagcctggagctgtgtctactctgcgggccgagcccacccctcagccagttgtatccacagcttctggagcgctggtggcagccactgctggacccgttgcgggcctgtctgccgttgggaccccgggcgctgcccagtggcttcccccttcacacagacatcctcgggctgctgctcctccacctggaactgaagcgctgcctcttcaccgtggagcccttgggggataaagagccttcaccagaacagcgccggcgcctcctccgaaacttctataccctggtcacctccacgcacttcccaccagagccagggccaccagagaagacagaagatgaggtctaccaggcccagctgcccagagcttgctacctggtgttggggactgaggaaccaggcacaggagtgcgtctggtggccttgcagctggggcttcggcggctgctgctgctgctgtctccccagagtcccacccatgggctgcgaagcctggccacccacactctgcatgccctcaccccacttctttgactacctagcagtgggtgatggacacagacatggggctgttagcgtctctctgtttattcgctcacaataatacacagcccctggatggggagggggcagtaagaccacgaacgcttaccttttgctgccattatgtactgtagctcctgtgtgcgcgcttacatgtgattgacgttacataagcagaggcccttgctttgttcctctcctccaggggactcatattctggttggagcgcctccccggtgtcctatcctgggggggggggaggggcgccgtcttccctacgcgcaattcctgcaggaggtgccgcgcccccgatcgcgttcggctgtcggcgcggcc

SEQ ID NO: 38 - DNA, 1047 bp, Homo sapiens
  CDS (58)..(786)
ttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcgactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgaagcccctggagtttggcaagcccaacactttggtctgttttgtcagtaatctcttcccacccatgctgacagtgaactggcagcatcattccgtccctgtggaaggatttgggcctacttttgtctcagctgtcgatggactcagcttccaggccttttcttacttaaacttcacaccagaaccttctgacattttctcctgcattgtgactcacgaaattgaccgctacacagcaattgcctattgggtaccccggaacgcactgccctcagatctgctggagaatgtgctgtgtggcgtggcctttggcctgggtgtgctgggcatcatcgtgggcattgttctcatcatctacttccggaagccttgctcaggtgactgattcttccagaccagagtttgatgccagcagcttcggccatccaaacagaggatgctcagatttctcacatcctgcccaggatctcctcttagggtagaagaagtctctgggacatccctggggtgtgtgtgtagatttcccacctggggactctgctgtccctgggcttgcatcccagggatcccagagtggcctgcctatcacaaccacatcccttccccccacaaggcaataaatctcatttctttaaaaaaaaaa

SEQ ID NO: 39 - DNA, 1964 bp, Homo sapiens
  CDS (140)..(1729)
tttcgtcgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctctgtgacctcccgagcccaggactggagttgtctggagaccacgcgtctaaccaaggagctgtgaacgctcaggacccagagggggctgtgatgaaagagaaggccagctttctcccgcctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgaaaaaaaaaaaaaaaaaa

SEQ ID NO: 40 - DNA, 6249 bp, Homo sapiens
  CDS (273)..(6026)
aaataggagaaacagtccagattcttgaaaaatgtgaaggttggtacagaggagtttcaacaaagaagccaaatgtgaaggggatctttcctgcaaattacattcacttgaaaaaggcaattgtcagtaatagggggcagtatgaaactgtggttccacttgaagattctattgtgactgaggttacagcaactctacaagaatgggcaagtttgtggaaacagttgtatgtgaaacacaaagtagatcttttctacaaactacgccatgtgatgaatgaacttattgacctgcgaaggcagctactgtctggtcacctgactcaggatcaggtgcgggaggttaagcggcacatcaccgtgcgcctggactggggtaatgaacatttgggcctggacctggtgcctcggaaggactttgaagtagtggactcggaccagattagtgtctcagatctctataagatgcatttatctagccggcagagtgtacagcaaagcacatcccaggtagatacaatgcgcccacgtcatggggaaacatgtcggatgccagtgccacatcacttcttcctcagcctgaagagtttcacttacaatactattggggaagataccgatgtcttcttttccttatatgacatgagggaaggcaagcagatcagtgagcggtttctggtaagactgaacaagaatggtgggccgaggaacccagagaagatagaacgaatgtgtgccctttttacagatctgagcagcaaagatatgaagagagatttgtatatcgttgcccatgtgatccgaataggccggatgctcctgaacgactcaaagaaaggtcctcctcacctgcactacaggcgaccatatggctgtgcggtcctaagcatcttggatgtcctacagtcactcacagaagtaaaggaagaaaaggattttgttcttaaggtttacacgtgcaacaacgagagtgagtggtcccagatccacgagaacatcatccgaaagtccagtgccaagtactctgcccccagcgccagccatggtcttatcatttctctgcagcttcttcgtggagacatggaacagattcggagagaaaatcccatgatatttaataggggattggcaattacaagaaaattgggatttcctgatgtcattatgccaggtgatatccgcaatgacctgtacctaaccctggagaagggggatttcgagagaggaggaaagagtgtacaaaagaatattgaagtgaccatgtatgtgctttatgcagatggagaaatcttgaaggattgcatcagcttgggttcaggagagccaaataggagttcctaccactcctttgtcctctaccacagtaatagtcctcgctggggagaaattatcaaattgcctatccccattgaccggttccggggctcccacctgcgctttgagttcagacattgttccacaaaggacaaaggggaaaagaaactctttggctttgcattctcaaccctgatgcgtgatgatggcaccaccctctcagatgatattcacgagctttatgtgtacaagtgtgatgagaatagcacgtttaataaccatgctctgtacctgggcctgccctgctgcaaagaggactacaatggctgccctaatattccttctagcctcatcttccagcgcagcaccaaagagtctttcttcatctccactcagctctcctctaccaaactcacccagaatgtggacctcctagctctgctgaagtggaaagccttccccgaccggatcatggatgtactagggcggctgcggcatgtcagtggggaggaaattgttaagtttctgcaggacatcttagatacactctttgtgattttggatgataatacagagaagtacggcctgttggtttttcagtctctggtgttcatcatcaacctgctccgagacatcaagtattttcactttcgacctgtgatggacacgtatatccagaagcactttgctggagctctggcatacaaggagctcatccgctgtttgaagtggtatatggactgctcagcagaactgattcgacaggaccacattcaagaagctatgcgggccttggagtaccttttcaagttcattgtacagtcacggatcctgtactcacgagccacttgtggaatggaagaggaacaattcagatccagtatccaagaacttttccagtccatccggtttgtgctcagtctggacagccgaaactcagaaacactcctttttactcaggctgcactcctcaattctttcccaaccatctttgatgagcttctgcaaatgttcaccgtgcaagaggtggcagagtttgtgagagggacactggggagcatgcccagcactgtgcacattgggcagtcaatggacgtggtcaagctgcagtccattgccaggacagtggatagccgcctgttttctttctcagaatcccgccgcatcctgcttcctgtggttctccatcacattcaccttcacctgaggcagcagaaagagctgctaatttgctcagggattcttggcagcatcttctccatcgtcaagaccagctctctggaggcagatgtcatggaggaagtagagatgatggtggagagcctcctggacgtgctcttgcagactctgctcaccatcatgagcaaatcgcacgctcaggaggcggtaagagggcagcggtgcccgcagtgcacagccgagatcactggcgagtatgtgtcctgccttctctcactgctccgccagatgtgtgacacccatttccagcacctcctggacaacttccagagcaaagatgaactcaaggaatttctgctgaagattttttgcgtgttccggaacctgatgaagatgagtgtcttccctcgggactggatggtaatgagactgctcacaagcaatattatagtcactactgtccagtacctgtcctctgcactgcacaagaatttcacagagactgactttgactttaaggtgtggaattcttactttagcctggcagttctattcataaatcagccaagccttcagctagaaattatcacctcagccaaaaggaagaagattctagataagtatggggacatgcgtgtaatgatggcctatgaactgttcagcatgtggcagaatttgggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtggaggccgagttgattgacaagctggacagcatggtgtcagaagggaaaggtgacgagagctacagggagctcttcagcctactaacccagctgtttgggccctaccccagcctgctggagaaggttgaacaagaaacatggcgcgagaccggcatttcctttgtgacctcagtcacccgcctcatggaacgtcttcttgactacagggactgcatgaaaggagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagccccatgaacttgatgggcacaggccgccattcatcatcctctctctcctcacatgcgtctagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaaggtcattactccctacactttgacgccttccaccaccctctgggtgatacccccccagccctccctgcccggaccctgcgcaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggttccattgctcctgggagcgctaaggaggagcaggcccgcatggcctgggagcacggccgaggggagcagtgaggggcaacaaggcggctaggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatggg

SEQ ID NO: 41 - DNA, 2653 bp, Homo sapiens
  CDS (1794)..(2054)
tttcgtattagtcatcagccagaacttcctgttctgtgggtctggggtcaccagctgagatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatccttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcagaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattattttttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttaaaaaaaaaaaaaaa

SEQ ID NO: 42 - DNA, 2854 bp, Homo sapiens
  CDS (122)..(2851)
gtaggcagagcaggacgccgctgctgccgccgccaccgccgcctccgctccagtcgcctctggtccttcaaactcacacctcccgggaggagctgtcctggcgccgggtcccgcggggaaaatggtggagccagggcaagatttactgcttgctgctttgagtgagagtggaattagtccgaatgacctctttgatattgatggtggagatgcagggcttgcaactccaatgcctaccccgtcagttcagcagtcagtgccacttagtgcattagaactaggtttggagaccgaagcagcagttcctgttaaacaagaaccagagactgtacctactccagcactattaaatgtgaggcagcagcctccatctactacaacatttgtgctgaatcaaataaatcatcttccacccttgggatctacaattgtaatgactaaaacaccacctgtaacaaccaacaggcaaaccatcactttaactaagtttatccagactactgcaagcacacgcccgtcagtctcagcaccaacagtacgaaatgccatgacctctgcaccttcaaaagaccaagttcagcttaaagatctactgaaaaataatagtcttaatgaactgatgaaactaaagccacctgctaatattgctcagccagtagcaacagcagctactgatgtaagcaatggtacagtaaagaaagagtcttctaataaagaaggagctagaatgtggataaacgacatgaagatgaggagtttttccccaaccatgaaggttcctgttgtaaaagaagatgatgaaccagaggaagaagatgaagaagaaatgggtcatgcagaaacctatgcagaatacatgccaataaaattaaaaattggcctacgtcatccagatgctgtagtggaaaccagctctttatccagtgttactcctcctgatgtttggtacaaaacatccatttctgaggaaaccattgataatggctggttatcagcattgcagcttgaggcaattacatatgcagcccagcaacatgaaactttcctacctaatggagatcgtgctggcttcttaataggtgatggtgccggtgtaggaaaaggaaggacgatagcaggaatcatctatgaaaattatttgttgagtagaaaacgagcattgtggtttagtgtttcaaatgacttaaagtatgatgctgaaagagatttaagggatattggagcaaaaaacattttggttcattcgttaaataagtttaaatacggaaaaatttcttccaaacataatgggagtgtgaaaaagggtgttatttttgctacttactcttcacttattggtgaaagccagtctggcggcaagtataaaactaggttaaaacaacttctgcattggtgcggtgatgacttcgatggagtgatagtgtttgatgagtgtcataaagccaaaaacttatgtcctgttggttcttcaaagccaaccaagacaggcttagcagttttagagcttcagaacaaattgccaaaagccagagttgtttatgctagtgcaactggtgcttctgaaccacgcaacatggcctatatgaaccgtcttggcatatggggtgagggtactccatttagagaattcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcatcgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcaactagctcgagaggaaatcaagaatggaaaatgtgttgtaattggtctgcagtctacaggagaagctagaacattagaagctttggaagagggcgggggagaattgaatgattttgtttcaactgccaaaggtgtgttgcagtcactcattgaaaaacattttcctgctccagacaggaaaaaactttatagtttactaggaatcgatttgacagctccaagtaacaacagttcgccaagagatagtccttgtaaagaaaataaaataaagaagcggaaaggtgaagaaataactcgagaagccaaaaaagcacgaaaagtaggtggccttactggtagcagttctgacgacagtggaagtgaatctgatgcctctgataatgaagaaagtgactatgagagctctaaaaacatgagttctggagatgatgacgatttcaacccatttttagatgagtctaatgaggatgatgaaaatgctaacagtaacaccaacagtaacagtagccttataacaagtcaggatgctgtggaaagggctcagcagatgaagaaagacctgcttgataagctagaaaaattagctgaagacctcccccctaataccctggatgaacttatcgatgaacttggtggccctgagaacgttgctgagatgactggccgcaagggacgggttgtgagcaatgatgatggaagcatatcttatgagtcaagatctgaacttgatgtgcctgtggaaatactaaacatcacagaaaaacaacgatttatggatggagataaggaagccttggaagatcgtttggaaaggattaatcgagaactgggttcagttcgcatgacgctaaagaaattccatgttttgcgcacctctgcaaatctttga

SEQ ID NO: 43 - DNA, 1041 bp, Homo sapiens
  CDS (80)..(454)
  misc_feature (1)...(1041): n = a,t,c or g
gtggcctgaggagcggaggggggatgtgtggattccggtgaaagggacctgacaatcgcccccaacccctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcncaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgaaaaaaaaaaaaaaaaaaaacactt

SEQ ID NO: 44 - DNA, 678 bp, Homo sapiens
  CDS (413)..(601)
  misc_feature (1)...(678): n = a,t,c or g
gccagtccccgcacagaaccacttttactcttcgaagaaaaaatcaagcacagaacagaaaatcntactctcccctcccgccgcactctcccccgttgcccgagatggccaagttcaggcctgtgcaatgccgcttccctctgagcctccctctcaagggccacgcaggcagctgcagcagggccagctgcaggatggggctgccggtcactgaattgtcgttcaaatgcatcatctttgtggcgtctttctcatgcgagcaaagccacgtgctctcctgtctgctgtcacatctgtgcctggattgcttaaatattgtttgtgatggggaggttttaatctggtgatgcagagggaagcagggctgtgggggcacgtttaattggctcccagcagcgtggggagtgcttctatggtgtgtggggttttttgttgcctccctctagaagtgttaccgttttcacgtcctattaatgtcctctggttgttaaattacagcagcacattacagtgcactgggttccctcctggagtgaatacaaacggagggcatctacttgtatttttagaagttttgggagaatttagtgatttgtggctttgatcaatcctgttgactggtgtatgtctgcgcaaacctgtttcaaataaatcttttgttaaagtaaaaaaaaaaaa

SEQ ID NO: 45 - DNA, 754 bp, Homo sapiens
  CDS (45)..(509)
agataaaagcgaaacaggaagtcccgcccctctatggaaagtaaatggtagctcggaagggtcaaaagagtccgcggtttcgccgcgtgacttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacatgcaaaaaaaaaaaa

SEQ ID NO: 46 - DNA, 3742 bp, Homo sapiens
  CDS (31)..(3267)
gagactggcgtccggtgtgcaggtggccacatggatcctggcagccggtggcggaacctgcccagcgggcctagcctaaagcacttgactgacccctcttatggaatcccgcgggaacagcaaaaggcagcgttgcaggagctgacgcgggcgcacgtggagtccttcaactacgctgtgcacgagggtctcggcctcgcggtgcaggctgatatcaactgggcagtgaatggaatctcaaaaggaatcattaagcagtttcttggctacgttcccatcatggtgaaatccaagctttgcaacttacgtaaccttcccccacaagccctcattgagcaccatgaggaggcagaggaaatggggggctattttataatcaatggcattgaaaaagtcatccgaatgttgattatgcctcggagaaattttcccattgcaatgataagaccaaaatggaaaaccagagggcctggttatactcagtatggagtttcaatgcactgtgtgagggaagaacattccgctgtcaatatgaacctccactacttggaaaatggcacagttatgttgaactttatttaccgaaaagaactgttctttcgtcctttgggatttgcacttaaggcacttgtcagcttttctgattatcagatctttcaggagctcatcaaaggaaaagaggatgattctttccttaggaactctgtttctcagatgttaaggattgtaatggaagagggttgtttgacacaaaaacaggtccttaactacctaggtgaatgcttcagagtaaaactcaatgttcctgactggtacccaaatgagcaagctgcggagttcctgtttaaccagtgcatctgtatccacttgaaatccaatactgaaaagttttatatgctttgtctcatgacgcgaaagctctttgctttagccaaaggagagtgcatggaggacaatcctgatagtttggtgaaccaggaagtcctcacaccgggtcagctcttccttatgttcctgaaggaaaaactggaaggttggttagtgtctattaaaatagcttttgataagaaggctcagaagaccagtgtttccatgaacactgacaatttgatgaggatttttacaatgggcatagaccttacaaaaccatttgaatacctttttgctactgggaatctgcgttctaaaacaggtcttggcctcctacaagattctggactttgtgttgtggctgacaagctgaacttcatacgctacctctcccatttccgctgcgtgcacagaggggctgattttgccaagatgaggacccccccagtacgcaggctgctgccagagtcctggggcttcctttgtcccgtgcataccccagacggggagccctgtggcctgatgaaccacctaactgccgtatgtgaggttgtcacacagtttgtgtatacggcatctattccagctttactgtgcaacttgggggtcactcccattgatggagctccccaccgatcatacagtgagtgctaccctgtcctgctggacggtgtcatggttggctgggtggataaggatcttgctccaggcatcgcagattctcttcgtcattttaaggtgttgagagagaaaagaattcctccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctttctctgatcacaaccagagtccacggaacatgtaccaatgccagatgggtaagcaaactatgggctttccacttctcacttatcaagaccgatcggataacaaactgtatcgtcttcagactcctcagagtcccttggtgagaccctccatgtatgattattatgacatggataactatccaattgggaccaatgccatcgttgctgtgatttcttacactggctatgatatggaagatgccatgattgtgaataaggcctcttgggaacgaggctttgcccatggaagtgtctacaagtctgagttcatagacctctctgaaaaaattaaacaaggagatagtagcctggtgtttggcatcaaacctggtgacccacgcgttctgcagaagttagatgacgatggattgccgtttataggagcaaaactgcagtacggagatccgtattacagctacctcaacctcaacaccggggaaagttttgtgatgtactataagagtaaagaaaattgtgttgtggataacatcaaagtgtgcagtaatgacactgggagtggaaaattcaagtgtgtttgcatcactatgagagtgcctcggaacccaactatcggagataaatttgccagtcgccatgggcagaagggcattttaagcagattgtggccggctgaggacatgccttttactgagagtgggatggtcccagacattctgttcaatccccatggttttccatcccgcatgaccattgggatgttaattgagagtatggccgggaagtctgcagctttgcatggtctctgccatgatgctacacccttcatcttctcagaggagaactcggccttagaatactttggtgagatgttaaaggctgctggctacaatttctatggcaccgagaggttatatagtggcatcagtgggctagaactggaagcagacatcttcataggagtggtttattatcagcgcttacgccatatggtctcagacaaatttcaagtaaggacaactggagcccgagacagagtcaccaaccagcctattgggggaagaaatgtccagggtggaatccgttttggggagatggaacgggatgcgcttttagctcatggtacatcttttctccttcatgaccgcctcttcaactgctcagatcggtcggtagcccatgtgtgtgtgaagtgtggcagtttactctctccactgttggagaagccacccccttcttggtctgccatgcgcaacagaaaatacaactgtactctgtgtagtcgcagtgacactatcgatactgtttctgtgccttatgtttttcggtattttgtagctgaactggcagctatgaacatcaaagtgaaactggatgttgtttaacttgatgttgaccttttggattaagaggactatcagattaaagcaaaatgtaattttaattcaatgaagatatcattaccaggttactcttgagatttttcaacggtgttagaactctcaaccaagacctgaaaaccaagtatgcaaggtttctgaatctctctggtagattaactattgacaatgattttctgttatctttgttcaaaaagttcatgtcttctcaaaatatgaaatattgataaatggaagagcatacggtgacaagtctcctttccaaccccaggttccctacaccctgctctcagcaggcagtgagtgtcacacacctgttaatccatcttgagcaggacagtactatacaaatagaatgcaagctgtaatgtaattttatattttcttatagccacgttgaagtaaaaacaaacaggtacagtgttttttaccagctttatagaagtacagttgttac

SEQ ID NO: 47 - DNA, 935 bp, Homo sapiens
  CDS (255)..(878)
gcggcgagttctgggggcgcgacgatggagggagtggcttgggacctgcactcattccctcttgtcccatactggagtttgaggagccactttcccgtccctccactgtggagctgcgttcctgtgagggaggaggccctctgtggtggcgagggtgagctgagcggacgccgccgagtcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaaagtttcctaacggctctctgtgatgttggcaatctaattaatcaagaatatactccacaaattgaaaaaaaaaaaaa

SEQ ID NO: 48 - DNA, 6376 bp, Homo sapiens
  CDS (955)..(3705)
atgtttcggaacccagggtctgtgatgggaatccggttacctgctccttccaaaccctctgagactccgccatcttccacttcgtcctctgctttctctgtcatgaatcctgtaattcaagctgttgggtcttcttcagcagtgaatgttatcactcaggcaccatcattgctttcctctggagctagttttgtgtctcaggctggtacattgaccctgaggatttctcctcctgaaccacaaagctttgcaagtaaaacaggctctgaaaccaaaataacttatagctcaggaggacagcctgttggtacagccagtcttattcctctccagtctggtagttttgccttgttacagctcccaggacaaaagcctgttcctagctccattcttcagcatgttgcttcccttcagatgaaaagagaatctcagaatccagaccagaaagatgaaacaaactcaataaaaagagagcaagaaacgaagaaggttctacagtcagaaggagaggctgtagaccctgaggctaatgtaataaaacaaaactcaggagctgctacctcagaagaaactctgaatgattccttggaagataggggtgatcatttggatgaagaatgccttccagaagaaggttgtgcaactgtcaaaccatctgagcattcctgtatcactgggtcacatacagatcaagattataaagatgttaatgaagaatatggggctaggaatcgtaagagttccaaagaaaaagtggctgttctggaagttaggaccatttctgaaaaagccagtaataagacagtccaaaatttaagtaaagtacagcatcaaaaacttggtgatgtgaaggtggaacagcagaaaggatttgacaatccagaagaaaactcaagtgaatttccagtcacctttaaggaagaaagtaaatttgaattgtcaggaagcaaagttatggagcagcaatctaatctacagccagaggccaaagagaaggaatgtggagactctctggagaaagacagggaaagatggagaaaacatctgaagggccccttaaccaggaaatgtgttggagcttcacaggaatgtaagaaagaggcagacgagcagttaattaaagaaacaaagacatgtcaggaaaattcagatgtgtttcagcaagaacaaggcatctctgacttacttggaaaaagtggaactgaagatgccagagttttgaaaactgaatgtgattcttggagtaggatttctaatccttcagccttctccattgttcctaggagagctgcaaaaagcagcagagggaatggacattttcagggtcacttactgctacctggagaacagatacaaccaaagcaagagaagaagggtgggagaagcagtgctgacttcactgttttggatttggaagaagatgatgaagatgataatgagaaaactgatgattctattgatgaaattgtggatgttgtttctgactaccagagtgaggaggttgatgatgtagaaaagaataactgtgtagaatacattgaggatgatgaggagcacgtggacattgagactgtagaagagctctcagaggaaattaatgttgctcacctgaagaccacagcggcccacacacagtcattcaaacagccgtcctgtactcacatctctgcagatgaaaaagcagctgaaaggagtcgaaaggctccaccaattcctctaaaactgaagcctgattactggagtgacaaactacagaaagaagcagaagcgtttgcttattatcgccggacacacactgccaatgagcggcggcggcgtggtgaaatgagggatctctttgagaaattaaagatcacattgggattacttcattcttccaaggtttccaaaagtctcattcttactcgagccttcagtgaaattcagggactaacagatcaggcagacaaattgataggacagaaaaatctcctgactcgaaaacggaatattctgatacggaaagtatcgtctctttcaggtaagacagaagaagtggtcctgaagaagctagagtatatttatgcaaaacagcaagcactagaggcacaaaaaagaaaaaagaagatgggatcagatgagtttgacatatctcccagaattagcaaacagcaggaaggatcttctgcatcatctgtagatcttggacagatgtttataaataacaggagggggaaacctttgattctttccagaaaaaaagaccaggccacagaaaatacctcacccttgaacactccacacacctctgccaaccttgtgatgactccgcaagggcaattgctcaccctaaaaggtcccctattctcaggaccagtggtagctgtttctcctgatctcttagaatctgatcttaagcctcaagttgccggtagtgctgtggctctaccagaaaatgacgacttatttatgatgccacgaattgttaatgtgacatcattggccacagagggaggtttggtagatatgggtggcagcaaatatcctcatgaagttcctgatagcaagccatctgaccatctgaaagacaccgtcaggaatgaagataattccttagaggataagggtagaatctcttccagaggaaacagagatggcagagtgacgttgggtccaacgcaggtttttctggcaaacaaagattctggttatccacaaatagttgacgtttccaatatgcagaaagcacaagagttcttacctaaaaagatttctggtgatatgagagggattcagtataaatggaaagagagtgaatcaagaggggagagagtgaagtcaaaggattcttcatttcataaattaaagatgaaagatctcaaggactcaagcatagagatggaactgaggaaagtaacatcagctatagaggaagcagctcttgattccagtgaactgctgactaacatggaagatgaggatgatactgatgagacactgacttcactgctcaatgaaattgcctttcttaatcaacaactaaatgatgactctgttggcctggctgaactacccagctctatggatacagagttcccaggggatgctcggcgggcttttattagtaaggttcctcctggaagcagagcaactttccaggttgagcacttgggaactggtttgaaagagttgcctgatgttcaaggggagagtgactctatcagtcccctcctcttgcacttggaagacgatgacttttctgagaatgaaaaacaacttgcagaaccagcctctgagccagatgtccttaagattgttattgactctgaaataaaggattccctcctttccaacaagaaagctattgatggagggaagaatacttctggcctccctgcagagcccgaaagtgtgtcctcaccccccaccctacacatgaagactggcttggagaacagcaacagcacagacactttgtggaggcctatgccaaagttggcccctctaggtttaaaagtagctaatccttccagtgatgcagatggtcagagtctcaaggtgatgccttgtttggcacctatagctgccaaagttgggtcagttggacacaaaatgaacttaacagggaatgaccaggaaggccgggaaagcaaggtgatgcctacattggcacctgttgtggctaaattgggcaactcgggggcctcaccaagttctgcagggaaatgaacttacttgtccttaagcagaagccaggctgtgaggggaaattgatctcacctcctttctctgcaggcatctgtttgtttgtgtcttagaacttggatccttgacttcaatgatgcagtggataatgatgggagaaagggggtagggtgctgaccctggtataagaagtactctgaaattctgatcatgttaaaatgtgttacctcacttgtggtgctgggtcccctcatcctctctaagaagatgtgatccattactgaacatgaggtgcccctcttacccaaggaatttataacatgactctggctccacagtggtttctagttcttcccccacaagcgaaagagctgtttgcaactttggagttgctgtagactgaactgtagcttgtagctgttgaattaagtccaaaatctaaggaatgcgatggacttgtgcaaagggatccagaagagacactttttagttgatgtttcaagaatagggagagagaggatgggtaccatggaataccaaagtgaaggactttgtgtcattcagtaaaattttcttttttcatatcctaagtagctcccattccctcaccttttcaatcagaattaacaaattcaagccttcagtaaagtagggatgcttttaacttttattattaattattttgagatcttaaaaaaatagtagttctcccttattatttttgtgggcattgaaaagctcatttcacagtaccagagatttttactgggagtatatattttggaggtaggcatagagggagccctaccccttccacaaattacgttactcaagagacagctaaaataaaatgcattatctccccagaccagagacagtggccaaaataaaaaatcatggggctggaaatttcccaaatcaaaccagcctcctggtgcttgaaggtttcattcactattacctgcacaggatgtaaagaaaagtcacagtaggcactctttaccagggaaataaggcagtatttgaatcacaagatatattttttatctgcaaccatggatccaatgatctgtagagctttttcactcattaactgtcaggatatgaaggactgacagtctgtaaagatatttatatttttgtatagttgttttcatagatttctcaaaggctgaagttttcaacctagaagatgagatttgtattgagtatagaaatgatgtttcctatctagtttgtaaataatcatggtgcacttgaggggtctcttggaaactcctagggggtcaagaatcactattctgaaactgtatagactgggatttagctgctgcattttgcctttcttaaataattatattttggaatgtaacccctgttctgtcttcattgacaggatttgcttgtgttgttaaaacactaacacaagagcttccagtgcctgggccgtgcctaggtgatgctatttcttctatatctcctgtcttctttatcccaaatcccactcagcatatcttcagacctaggttgtaagaccaactttggattggatctagccagtgaattattatttccatggttggttccctttctgttaactctggtaatcaacagattgaaaacggtggaagaacttcttctgaaaattgcagtgggagcaaattcttgttggttttgtgctgcttgcctttctagatctgctcatcagcacttaaccttccctcctctaaaggttactaaagaagcctgaagtaggtaaagagtgctcctcagcttcttatccttccactctttacccagcagatttcattcaatgccttagccaaggagtccagcacctgtctcccctgctaataattgtccttagagatgctagtactttaatccaggtatagcagtttcccgttattttcttgcttgtcgttcccctacatttcctcctgatttcccaagactctctttgtggcttttgagggtcagccaaggagcaggcaagtgagtgaacaatcctcaggaaaagaaggaccattttagcttaacacttcctttttttttttttttttttaagaagaatataggtaaacaggtaatgattcttgattggagataccatttgactcttgatgagagttgtacgaagatggaaatgagggatgattccaggcgttttagggggaaggctgcagataccattctaacccccaagatactgtgttctcaagacctcttagaactaggtgttgtcagggataatttgaggagggcttagtcttcagaacaatcctgcagtcttgacagaaatctaaaatctccaaaaactcctaccctttaaccttaccctagggggaactgatctatgaatattacatgtgtgattatgaaaggtgaagttgagtgagaggagttgaggaacgtggaagacagtgagctctcaccctaacactataagaagcatgatctcaatagaccaataattcacctttttatacatctgtaaataaatggaatgtttttaagaatataattatgtcagatttagcattttcttttatatattaaatatatatatctttccttttctgctttcgaaaagtgactatttttttagaaatctaagaacagaagtttggtgattgaaaggtagaatatataaacctgaaataaagcagttaaaacaattaaaaaaaaaaaa

SEQ ID NO: 49 - DNA, 1127 bp, Homo sapiens
  CDS (319)..(753)
tttcgtcggcgggcgtggttcgagagcgcgcagagtccagactggcggcagggcccgaggggccgacccgcagcgtccctggtctctccagccctcactcggaaccgcacggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctacagtgacaataccctcccctcccttgggctggacccctctctacagctaggagccaatggcagaagacaaaaccaaaccgagtgagttggaccaagggaagtatgatgctgatgacaacgtgaaaatcatctgcctgggagacagcgcagtgggccaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatggtggggccatccctgcacctgggtgttagcaattcactggggacctgccctcatacatttcctcctccattccccgggcaggcaaccttcagtgattggtcctccctcccacgataagatacaacccttggttggttgcttgcattcttcccaccttataaagaagccagctaagccgacctgccctctttccaagacacagatccctattaactgagctctttctaggacctgtttcccaatcatccctgcctatcccactttctggaatgaaggcctccagtggcccccccctccaaaccttcttcccttcccttgacagacagaccaatgtcctaccttctctctacagcagacataaacgtgacccaaaaaagcttcaattttgaaaaaaaaaaaa

SEQ ID NO: 50 - DNA, 2765 bp, Homo sapiens
  CDS (597)..(2087)
ggaaccgccccggaaccccgggtcgacgatttcgtgctccgaccacgacagggaaaggaactgaccaacactggatgaatttgaccatttcttaagagactggaatgttaagtttctataaatgaatgaaccagttctctcttgtttggagcaatgctgaaattccaagaggcagctaagtgtgtgagtggatcaacagccatttccacttatccaaagaccttgattgcaagaagatacgtgcttcaacaaaaacttggcagtggaagttttggaactgtctatctggtttcagacaagaaagccaaacgaggagaggaattaaaggtacttaaggaaatatctgtaggagaactaaatccaaatgaaactgtacaggccaatttggaagcccaactcctctccaagctggaccacccagccattgtcaagttccatgcaagtttgtggagcaagataatttctgcattatcacggagtactgtgagggccgagatctggacgataaaattcaggaatataaacaagctggaaaaatctttccagaaaatcaaataatagaatggtttatccagctgctgctgggagttgactacatgcatgagaggaggatacttcatcgagacttaaagtcaaagaatgtatttctgaaaaataatctccttaaaattggagattttggagtttctcgacttctaatgggatcctgtgacctggccacaactttaactggaactccccattatatgagtcctgaggctctgaaacaccaaggctatgacacaaagtcggacatctggtcactggcatgcattttgtatgagatgtgctgcatgaatcatgcattcgctggctccaatttcttatccattgttttaaaaattgttgaaggtgacacaccttctctccctgagagatatccaaaagaactaaatgccatcatggaaagcatgttgaacaagaatccttcattaagaccatctgctatcgaaattttaaaaatcccttaccttgatgagcagctacagaacctaatgtgtagatattcagaaatgactctggaagacaaaaatttggattgtcagaaggaggctgctcatataattaatgccatgcaaaaaaggatccacctgcagactctgagggcactgtcagaagtacagaaaatgacgccaagagaaaggatgcggctgaggaagctccaggcggctgatgagaaagccaggaagctgaaaaagattgtggaagaaaaatatgaagaaaatagcaaacgaatgcaagaattgagatctcggaactttcagcagctgagtgttgatgtactccatgaaaaaacacatttaaaaggaatggaagaaaaggaggagcaacctgagggaagactttcttgttcaccccaggacgaggatgaagagaggtggcaaggcagggaagaggaatctgatgaaccaactttagagaacctgcctgagtctcagcctattccttccatggacctccacgaacttgaatcaattgtagaggatgccacatctgaccttggataccatgagatcccagaagacccacttgtggctgaagagtactacgctgatgcatttgattcctattgtgaagagagtgatgaggaggaagaagaaatagcgttagaaagaccagagaaagaaatcaggaatgagggatcccagcctgcttacagaacaaaccaacaggacagtgatatcgaagcgttggccaggtgtttggaaaatgtcctgggttgcacttctctagacacaaagaccatcaccaccatggctgaagacatgtccccaggaccaccaattttcaacagtgtgatggccaggaccaagatgaaacgcatgagggaatcagccatgcagaagctggggacagaagtatttgaagaggtctataattacctcaagagagcaaggcatcagaatgctagcgaagcagagatccgcgagtgtttggaaaaagtggtgcctcaagccagcgactgttttgaagtggaccagctcctgtactttgaagagcagttgctgatcacgatgggaaaagaacctactctccagaaccatctctaggcaactatcaaaaagaagcagaagttcaagtggacaaatttatgtgaaaattcatttaacatataagctgaactctattatggggaatggatacaaaagcagagctcccatcttgactttcaattcctcatcagaagtactggcttctttagagagtagtaagcatggctgcctatgcttggagtcataagtgttatttggactataccctgagataagcttatagatcaagtttggctcccttgaaaagcatttctctcatgtgcgccctcagggcttccagcaggattgagtcaccctgacgatgaccggggagaagccgtgtgctcttcattattttcagctggaggacagagctcagtgcctgactgcctagggtctcatggactgtaggcagcctgccagtgaaggtcactggactctagcctacaacatgctgagctacagcccagaagccagacatgcctgtcttagctgacctgtttttggtccacttttgcccttccatgactaataaggaagatatgtgtgtatttcatacacacacaaggacctggattaaaaatccaaaaagtgattctcttctatgatttatttcaaactcatccatagataattcaagatttgtattcaaaataaacatagttttcacagttacaaaataaaaaaaaaaaa

SEQ ID NO: 51 - DNA, 1573 bp, Homo sapiens
  CDS (363)..(602)
gcacgagcgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgagctcctacatgttcgtggacgagaacacgttctccaacgacgccctgaaggtgacgttcctcatcacccgcctcacggggccagccctgcagtgggtgatcccctacatcaggaaggagagccccctgctcaatgattaccggggcttcctggccgagatgaagcgggtctttggatgggaggaggacgaggacttctaggccgggagacccttgggcctgggggcgggtgctctgggaagagttcgctgtgccagtggccaccgctagggtctccacaggcgccctccctccgcgcctccctccccctcgagccgccgcgatgtcccctgcgctcctgtcccctcccgcgtagtgcttgcctttgttccaggaatagcgctccaggctcctgctgcagctcctgggccgcactctagagcgcgctgcctccgccctcttttgccagcccagcccctccatgcacatttggacgctgtcctgcacttcaggtgcaagctgggctcctgttacatactggacagaccacccacagccgctgctgccaacccacctccactcctccagactgccagccaactacatcattctgcccacagacctacgctaccactgccatcgccatccaccgcatctcaccaacagactgtggctcctagtgatgtggactcacctcggaggtatccgagctggacacagcccctggacagtgatccagacagctggccgtcccccaaggagcctgtcaccttcagcgagacccatttcctccccatccccagagacctcttgtgttcctgccacatagctgccagggcttaagtgtgcctggcaaccaaatcgaatctctcattttctcctgtggaccagttagttttgcctagaatcctgttttcttctgaatttgcagctgtctctctgatgggtgccttttgttcaacacagtaagccctgctcccttccctgctctaatacactacctgtacaaaggttttttccttatttttaataaatgtcagacactattaaatagaaatggagtctcaatgaatatggcacctttccctccctggttctgtaaatagggtccatgtcttcttcaaatgctatgtgccctgtcatactacggctgaagttgactcttgcattataaaaacaaaagactgagtcctgtggagtgtcctagggatggagatcttatcggcaaccatctaatgccaaatgatgacccttctaaaccacgcagtttcatgccacttttgaggcagacattgatctgattttggccaaggcaatgtcaaaagctgtggaaaagctttttgtaaaaggtttccttattttcaaaaaatggctacaaaacacaaatctcaaattgctacataccact

SEQ ID NO: 52 - DNA, 1291 bp, Homo sapiens
  CDS (338)..(1189)
gcgcgaccatcatgtccatgctcgtggtctttctcttgctgtggggtgtcacctggggcccagtgacagaagcagccatatgtgagtgcagggtttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctaccgctcgagcgaccgcccgggcaggtcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggcttgcatgacaacccaaacggctcggacggcgacagcgcgccgctcaagctgactctgactcatcatactgcttgctctgccatacccttcccctcaactgtagcctc

SEQ ID NO: 53 - DNA, 2155 bp, Homo sapiens
  CDS (113)..(1726)
ggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaaaaaaaaaaaaaa

SEQ ID NO: 54 - DNA, 2356 bp, Homo sapiens
  CDS (2)..(1177)
catgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggcttttgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagatgcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccgggatcctccccttcccctaccctaagctgtagcctgggtgactgactggcctgggcctggggtggggacgtccccaagccaaattactccagggtctctgctcctcatggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaaaaaaaaaaaaa

SEQ ID NO: 55 - DNA, 1450 bp, Homo sapiens
  CDS (60)..(1427)
gggtgaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcttcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacatt

SEQ ID NO: 56 - DNA, 2032 bp, Homo sapiens
  CDS (60)..(2009)
gggtgaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacatt

SEQ ID NO: 57 - DNA, 1304 bp, Homo sapiens
  CDS (769)..(1098)
tttcgtgcgaccctccgccacttacccaccccggctcaagcacgacccgtggatccacgtgctttttcttgtccaatgggagccggctcccgggcgcgaaggggcggggaggaaaggaacgactgtgctacgttgccagaaggggcgggacctgcaacgtccgacagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagaggtagccccagggaggggagggaaagggacggtggagacctgggttagaccaagggttatagaaggaaagagagctacctcagggcttgaatgtggactagtcgtgaggagcagagtgcattgcttcctctagggttttatttcctccccaccctccaaattgttagctcacagccttacaggaaaggacgggggcgggcgcctgccctcagtctgatttctgagcgtccctgggtctgaccttaagggcaagggcagggagcttcacatttcaaatacagttgtggttacggcagcccagtacttttggccctccttgctgttcggttctcctcccttctcccaacctcctcactggtgttgctgggtgtggtcctcaatacagaatagagacccttgggcctgtgtcaccagacttctgaccccttgggcaacagccagatggagactggtcgccttttgagcctcagctctcttcctcttgttctcctagggtgggagtacagcagccaaacgctgaacttagtcccatccacttccatcttatcctttgtgcccttcatccccctgcatcttgtcctttttgccctctggtacctcccagtgccccatcatctctacccccagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccagtgttttttattcctgtggggctcaccccaaagtattaaaagtagctttgtaattcaaaaaaaaaaaaa

SEQ ID NO: 58 - DNA, 728 bp, Homo sapiens
  CDS (299)..(418)
aataaaagtgagtagggtgcccataatccggaagtttctttgtttaggaaaataaaaacaaggaacttcatagacccccccaaaggggaattctatatcttgacaagtaaaattttagatggaaattatctacaacaccacacttacggaaattgctatcctcactctattatttgcaaaagggttatacacagtagcaccttctaactgaagtattaaacagagtttccattgctgtcgtattttgcttaattattatccttatagcagggataatagttactaacaaaaaggaagcatgaaagttttactatcactgagcctggtaggactttttattgggtttagtgatgcagttttaaatgaaacatgccgcttttggattaatacctctagtaaaggaaaatttacagatacttaaaaatcaaatcaaaattattgataggctcaggaaaaatgccagcttcagccctgagtggctacaaaccctctttaataaattccagtcttctttatggaattggttaacgcctttattaagccctctcttgcttatatgtcttgtattgatatttggactctgtatatacaatactataactcgaaattgttttttcttgcctagaaaccatccaactcccaatggtggtttaaaccggaccaaaaaaggaccagggcttttttcccaggaccctttaatttatcccaggggggaccctaactgttat

SEQ ID NO: 59 - DNA, 635 bp, Homo sapiens
  CDS (310)..(534)
gattttcttctctttctaaggctaatggtggtagttttgttttttgacgttttcttataatgagtttttctttataatttttaatttatgctgtaatgtttcttatttacaatgttatctcttaaatctttgagtacattacattttctcccctgataatctcttctaaattaccttctctagttggttttcttcccttccttaatgttagccattcttcaggtgaaggttaatcctcaatgtactcttcatgtttaaggggagggtctaaaaccttgtgggtaggacttaccaacggagtttcattgcatgatgatcttattgagcttattggtagcccttatctcagtatctttagtttttcttgggctggtcagattttcaagagaagacttttcatttcctttgtggagggaaaaggccttttaccagcactcttcaagctcagtaggggaaagacttcaagcactcaggaagcatgcattcactttatttggaacaatacccttacttgtaactgtgcctcaggtgccatagtccacagagacttcttttacctgtccagagaataaaattagttgtctgttggggtaacaaaaagtgtggagctgaagagggtacctataaatgaagtt

SEQ ID NO: 60 - DNA, 2167 bp, Homo sapiens
  CDS (54)..(1526)
ctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaagaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaactgtcaaaaaaaaaaaaaaaaaaa

SEQ ID NO: 61 - DNA, 639 bp, Homo sapiens
  CDS (324)..(446)
cggcacgagctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccat

SEQ ID NO: 62 - DNA, 2728 bp, Homo sapiens
  CDS (194)..(2596)
aattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatggaaaagaatgaaaagataaggagtctagaaaccaatattaatacagagcatgagaaaatttgtttagcctttgaaaaagcaaagaaaattcacttggaacagcataaagaaatggaaaagcagattgaaagagttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctgtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttagagaatgcaagatggagattgaagacaaaaagcaggagctccttgaaatggatcaggcacttaaagagagaaattgggaactaaagcaaagagcagctcaggttacacatttggatatgactattcgtgagcacagaggagaaatggaacaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaattagagaaggcaaaattggaattagaagaagctcaggatactgtaagcaatttgcatcaacaagtccaagataggaatgaagtaattgaagctgcaaatgaagcattacttactaaagaatcagaattaaccagattacaggccaaaatttctggacatgaaaaggcagaagacatcaagtttctgccagccccatttacatctccaacagaaattatgcctgatgttcaagatccaaaatttgctaaatgttttcacacatctttttccaagtgtacaaaattacgtcgctctattagtgccagtgatcttactttcaaaattcatggtgatgaagatctttctgaagaattactacaggacttaaagaaaatgcaattagaacagccttcaacattagaagaaagccataagaatctgacttacacccagccagactcatttaaacctctcacatataacctagaagctgatagttctgagaataatgactttaacacgcttagtgggatgctaagatacataaacaaagaagtaagactattaaaaaagtcttctatgcaaacaggtgctggtttaaatcagggagaaaatgtgtaattcaaagaagatactgatgtgttgaaaaaatggaatttttggtactgtgctgtttacttattatatgtagctcatacttcatagaagctgttattttgcttttgaataaattttatatttcaatatttt

SEQ ID NO: 63 - DNA, 1633 bp, Homo sapiens
  CDS (489)..(803)
cggcacgagaaattaatattccttgggtctttcaaatgaatggttcaatgtgaggagcgaagtactgggaaatcgagggattttccacaatccccaagcagcttactcagtggaacctctgtttccccagctatgaaggaaatagcatcctacattccgtaaagtgcttgaagaagctctagctgagaatgctgaattttacagtcattgttttatggttacaagggtatgtcttcagggctctgttcattttccctcttgattttctcttttgaagatgccttgcccagtggcatggaaagaagcccacttgatgataggagcctgactatgaattgattgactaaacatgaccccaggtggaagctggctttgacaccagcttcctgttcagtctgaccactgctgtcctcctgctgcccaagagttgcacctggagcaaggaaccccaccatggctgtcgctctccatcccatcacgctagaatcatgtgtccaagggctcaccctggaggtgcacagcacaggtcagcctggccaggggcgaaggagacagtagagaggaagctcagggccttaggggaggccgggtgcaaacccgttctgcaccaagtgcactcggagtttgtgggtatgggtgtgtacccctgcaggtgtgcacatgtgtgcttgcacgcacatatttgtgcactcctgtgcgtatacatgtgtgcttgtgtatgcatatgtgtgcattcctgcatgtgtggacatgtgcgtgcatgcatctgtgtgtctgtgtgtgtgctgagacaggaaagggggtgaaagtgttggtgagggagcctggaagttttctcttccccaacctctcttgctctaaggagggatggggttgggggcagccattattgaaggtgatcggagaagaaagattttctgactcagaagtgactgccagtgtagcacaagcagtgtcccttgtgactgtgattctacagttctctgatcctcatgtttcctttagaggaaagaggaaaaaaggaactctgtggtgggtattgggagggaaaagaaaatagcctggtggaggcaggagggagtcgagtgtgagtaaggagcacctgcagcttttggaagtgaaagcagagagagggaaaggtagctaagacatccaggaggatcaaggggcagcgtgagaggcacagggggaggaaagggagagggtgagtggggccagggaagagaacggtgtggagttggtgggcagatggtgcaggaggagggctgggcagtggggagaggaagaatcagagcagagaaaccgctgctgcggaaggcagggagcaaagaagcataaggaaaagaacaggagaaagaacaaaggcagagaagacctcctcagctattttggtgctaggtaatgtgaaatgctgcagtaaataaaagccataagtaatgtttgattttacagtatttacaaaccatatgctttaaacagcccacaaactccatccagttgtctgatgatgtgggaggaccagctctagttagacggaggtatgtgattcgattctggtggagactttgtgccttgaaaggcttctcaggaaagcagtaataaaacaaagtgtccttgtttggcaaaaaaaaaa

SEQ ID NO: 64 - DNA, 944 bp, Homo sapiens
  CDS (434)..(718)
ttttttttttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaaggaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagaggagaaaagaaaaagagaacaattaaaaacaagaaaaacaaaactagatattctaaatttcacaagcgtttttcaaaaagagacgaggccatatttttccttaaagaaaattactttttttt

SEQ ID NO: 65 - DNA, 664 bp, Homo sapiens
  CDS (119)..(532)
atttatttgagatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgtgctccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaagaaaaaaaaa

SEQ ID NO: 66 - DNA, 3016 bp, Homo sapiens
  CDS (8)..(2530)
tttcgtcatggcgcaagctctgtctgaggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactggtagtgacctggcgtcgtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaaaaaa

SEQ ID NO: 67 - DNA, 5166 bp, Homo sapiens
  CDS (794)..(4495)
gggagcgaaccactgacccagggggccagcgggctgtaccaccggccctgcaacccggggggacgcgggggccgaagggctgaaccactgggcccggatggggctcacagagcggaacgctccacgagaatcgtgggggcgagggaaagggtcaagattaccagccattgaccaccctcccgggaagggccttagcctgggaagcacagcttctccgtcaagtttttcccgagctcccctcgcaatacaccaggaagctccgccccgtcggagactcaatcttcgcatctgcaaaatgggcgcaggggtgcaaatgggtggccgtggttgccggggctggggagatggcccacttgttccagccacggtcacctctcttctcagagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgactgcctgctgtggcctgcccctgtgtggcatgtgcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagacccaagaggaagagggaccagaggaggaggacgatgatgacattgtagacgctggagccattgatgacctggaggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcagcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacagtgagctgcccctggggccacaggctgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagcttactttgtctgcttgctgctgtagcctgtaccaggccaggtcttgtgaggtggaggctgcctggctccacagcgtgccctgtcctgccctgcccctgttaagtccggtgatccaccagcagggcagacccttgctgcagaggcctggcaatgagagaggtggctggttcagagacggctgaaccagcgagaccccagcaagcaccttcagaccttcttcctccctgggccctagggagcacacgctctgtgcctacagaatctctgaagctgatctcctgagccttgactgtgaggcacaccagcttcttcgctaatgttggggatcaagggcaacaaaagtcttgctttttgggttgggacaggcacac

SEQ ID NO: 68 - DNA, 772 bp, Homo sapiens
  CDS (103)..(255)
tttcgtggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaaattatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggtaatgccaagtcactgggaccaattttctgttttataatatctaagtttagaacagaatatatacctgaactgtagtggtttgatcggacgaaa

SEQ ID NO: 69 - DNA, 1241 bp, Homo sapiens
  CDS (521)..(727)
tcgtctttacgtttaaatgtatatcatgtgtctaaagttgctttaagttaccataaattgaaacttcggaatctttggatgtattagctgatgttttgatgtatttttccaatgccagaataatttttaagtgctttgagaaaggaaggcattgatggagaggggaggaaaataacccaacccagttatctatccatattagatacacgtgtacacacacaatatgcaatacacaacatctctctgtaaaagtacccttttcagacaaagaaaggaaggtaatttgttcatcaattttgttttcttttgaaattcaatccaatctggaagtggcataggtaaataataatattcttccttttctcttcctgtagggtgctggagatctagaagacccatggtagccttaaaaaccttctaaaatgcttttgattctgaaaattgggggaaaaaacttttaatcacaattttcttcaatacaaggggaaaatattcttgcggattcccaacgttttgtgatatgagcagaaaatcattagcatttcccatcatttgttcatatttgtgttttctgacagttgccacttgtagcattgcctgtactacagtattttttgccaacctcaggcatactcgttacatctgtattgaactttcggccctagaaaccagtggagttatttcaccacaaatcaacaatgtgcctgaggtgcatgggaaatatagttagctatactctgaaaatacattatgttttttttctttaaacaaaacacacaacatgtaagcatgtaagagtaaagaattgtatgatatgttccttttttcagttcaccaagttggaagccttttgcagctctgtggcttggaatttcatttgagcaatttctataggatatgtatttattattgattgttatttaatttttttccaattttacctgtattaccaaactgggttctccaataatgtccaaattgtaatgttgccttgcttcaagataaagtgtatttgggaataatattataaacccttacaaattttatgcatgtatctactgcatccttcaactctcactagaaaatcttttgaaaccaaatggattaatttatggctatttataatttgctttgacatctcactgttggaaattttttaaagatgagatttgcctttataatgtaaattgtgatttttgttttacatgtgggtttctatagctttaattttttcagctttt

SEQ ID NO: 70 - DNA, 1311 bp, Homo sapiens
  CDS (95)..(757)
gcaagaagcttggaagcggagtgttgcaacagtgcatcccgacagcagcaacctgatccccaagctttttcgacctgcagcgttcctgcctttcatggcgcccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgaggatttgaagaaagaacacagagtccaccgtgcccaggacacaggtgttaaatggataggccgtctcaagcggaacacgtacccctggggcgctgtttacgccctccgaccccaaaagcaatcttgtttccttactcagtgtcctccattctagacagctacttaaaacctttgccgccctccgcccagtgcctcctttctcctctctggcaaaggaccctgcctcctccgccaggaaacaggtcagcagtggagccccccacacccgcacccgtactgtattgcggccgctctggaggatccacgcaacgtgg

SEQ ID NO: 71 - DNA, 943 bp, Homo sapiens
  CDS (667)..(798)
caacatcttcatgccccaggagcccaagtttggagatctttgtttcattctcaaaggacagctctacttatccttccaatgatcactgccaagttctctttagccatgggatacaggcgcagatttattatatgaatatattacgtagtggcaaagtccaggcttttaaggggaagattatatctttttttttctctcacagacatgattgggaaggtgtttatttttcctaaagaatctaatagtgctcacgtgagcttgatcacacagctggagaaatctacagaacttcactgcgtgtcttcatgcttataccgacctctcccatggctatcgcctcttctcctacagcatccagaccaagagcaatgagatggtcatttttaagtctcaaattggggagtacaatcttatcattgggggtgacaaggttttcttcaaggtctgtgagaatttccccaccctggtgcacatctatgccagctgggagtcctcctcaggcattgctgagttctgggtcagtgagaagccttaggtgaggatggggctaaggcagggtttctctgtgggagcttaccccaagattgccctgggtagcagcagggttcctatggaggcaagtttggtaagagccagtccattgtgggagagattggagatgtgtacatgtgggactctgtgctgtccccagaagaaatctggtttgtgtatcaaggtatctacatcaaacccaatattctggactggcgggcattgaactatacaatgcaaggttatgtggtcacccagtcccataaatagagttgaagttctgcttcaacaggacaaagttactgggaaggaaatccccaacatgaaagaccagctctgaagacaattctacttcatgccttatgtctatttctctgttttctctgaatttcctatctattgaactgcttaa

SEQ ID NO: 72 - DNA, 602 bp, Homo sapiens
  CDS (155)..(418)
cccagagctgaggcaaggggatttctcaggtcatttggagaacaagtgctttagtagtagtttaaagtagtaactgctactgtatttagtggggtggaattcagaagaaatttgaagaccagatcatgggtggtctgcatgtgaatgaacaggaatgagccggacagcctggctgtcattgctttcttcctccccatttggacccttctctgcccttacatttttgtttctccatctaccaccatccaccagtctatttattaacttagcaagaggacaagtaaagggccctcttggcttgattttgcttctttctttctgtggaggatatactaagtgcgactttgccctatcctatttggaaatccctaacagaattgagttttctattaaggatccaaaaagaaaaacaaaatgctaatgaagccatcagtcaagggtcacatgccaataaacaataaattttccagaagaaatgaaatccaactagacaaataaagtagagcttatgaaatggttcagtaaagatgagtttggttgtttttgttttgttttgttttgtttttttaagtcggggctcgctctgtccacccgggtggttt

SEQ ID NO: 73 - DNA, 1177 bp, Homo sapiens
  CDS (1)..(903)
atgcacaaagactgggtggtctttgatgtgtctggagaacacaaagaaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccattacctcatggggatcccgaagccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacaaaaaaaaaaaaaaaaaaa

SEQ ID NO: 74 - DNA, 983 bp, Homo sapiens
  CDS (199)..(927)
ctactatacggctgcgagaagacgacagaaggggaggatgaggcaccgttccaggagaaagattccggcagcgatgaagatttcctaatggaagatgatgacgatagtgactatggcagttcgaaaaagaaaaacaaaaagatggttaagaagtcgtggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaaa

SEQ ID NO: 75 - DNA, 2253 bp, Homo sapiens
  CDS (1)..(1938)
atgcgggctccgggtgcgggcgcggcctcggtggtctcgctggcgctgttgtggctgctggggctgccgtggacctggagcgcggcagcggcgctcggcgtgtacgtgggcagcggcggctggcgcttcctgcgcatcgtctgcaagaccgcgaggcgagacctcttcggtctctctgtgctgatccgcgtgcgcctggagctgcggcggcaccagcgtgccggccacaccatcccgcgcatctttcaggcggtagtgcagcgacagcccgagcgcctggcgctggtggatgccgggaccggcgagtgctggacctttgcgcagctggacgcctactccaatgcggtagccaacctcttccgccagctgggcttcgcgccgggcgacgtggtggccatcttcctggagggccggccggagttcgtggggctgtggctgggcctggccaaggcgggcatggaggccgcgctgctcaacgtgaacctgcggcgcgagcccctggccttctgcctgggcacctcgggcgctaaggccctgatctttggaggagaaatggtggcggcggtggccgaagtgagcgggcatctggggaaaagtttgatcaagttctgctctggagacttggggcccgagggcatcttgccggacacccacctcctggacccgctgctgaaggaggcctctactgcccccttggcacagatccccagcaagggcatggacgatcgtcttttctacatctacacgtcggggaccaccgggctgcccaaggctgccattgtcgtgcacagcaggtactaccgcatggcagccttcggccaccacgcctaccgcatgcaggcggctgacgtgctctatgactgcctgcccctgtaccactcggcaggaaacatcatcggcgtggggcagtgtctcatctatgggctgacagtcgtcctccgcaagaaattctcggccagccgcttctgggacgactgcatcaagtacaactgcacggtggttcagtacatcggggagatctgccgctacctgctgaagcagccggtgcgcgaggcggagaggcgacaccgcgtgcgcctggcggtggggaacgggctgcgtcctgccatctgggaggagttcacggagcgcttcggcgtacgccaaatcggggagttctacggcgccaccgagtgcaactgcagcattgccaacatggacggcaaggtcggctcctgtggtttcaacagccgcatcctgccccacgtgtaccccatccggctggtgaaggtcaatgaggacacaatggagctgctgcgggatgcccagggcctctgcatcccctgccaggccggggagcctggcctccttgtgggtcagatcaaccaacaggacccgctgcgccgcttcgatggctatgtcagcgagagcgccaccagcaagaagatcgcccacagcgtcttcagcaagggcgacagcgcctacctctcaggtgacgtgctagtgatggatgagctgggctacatgtacttccgggaccgtagcggggacaccttccgctggcgaggggagaacgtctccaccaccgaggtggagggcgtgctgagccgcctgctgggccagacagacgtggccgtctatggggtggctgttccaggagtggagggtaaggcagggatggcggccgtcgcagacccccacagcctgctggaccccaacgcgatataccaggagctgcagaaggtgctggcaccctatgcccggcccatcttcctgcgcctcctgccccaggtggacaccacaggcaccttcaagatccagaagacgaggctgcagcgagagggctttgacccacgccagacctcagaccggctcttcttcctggacctgaagcagggccactacctgcccttaaatgaggcagtctacactcgcatctgctcgggcgccttcgccctctgaagctgttcctctactggccacaaactctgggcctggtgggagaggccagcttgagccagacagcgctgcccaggggtggccgcctagtacacacccacctggccgagctgtacctggcacggcccatcctggactgagaaactggaacctcagaggaacccgtgcctctctgctgccttggtgcccctgtgtctgcctcctctccctgcttttcagcctctgtctccttccatccctgtccctgtctggccttaactcttccctctttttcttttctttctttctttcttttttttttaagatagagtctcc

SEQ ID NO: 76 - DNA, 1203 bp, Homo sapiens
  CDS (35)..(238)
  misc_feature (1)...(1203): n = a,t,c or g
ggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcagggtctcttggtgccctgttctcttgtccccaccaccaacctattgcaggcaccaaagcacgtgcccgggaaatacccatttgaaaattaaggaaagaaaccaaccccgaccccccaagcccgaatcttaaagaaaacaaatgcggccccagcctctgaatgggcaaccccttatatggaagaagtggaccctatctctaggggctcggaaagcaagagagccacaaagtcttcctcagccgccttccggccagacgggtattagacaattgcctccaacttgctcccatgccgggtgggccctcgcaaccgttgggcgggattcccaagagcgcccctgaaggccaaatctcggggcccggaaagtgttagcccatttttctggggtcggtggggggagagaaggcccnatggagctttgagcggcaatgcaccgggtagcccctctccgactagagggggttctgcgtttggtgtgcgcgcgtgacatggggggcgtcccccgggcgtgaggaggaggacgntacagtctccggcccggtgcgcgaccct

SEQ ID NO: 77 - DNA, 914 bp, Homo sapiens
  CDS (532)..(657)
cggagccccgagcccgcccggcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttccccccaggtaacgattttctgttcaggcaacttcagtttaaaattaatacttttatttgactcttaaggggaactgaaggctatgagctgaattttttaatgaatattttacaggtagccgggtaatacatctgacgctag

SEQ ID NO: 78 - DNA, 947 bp, Homo sapiens
  CDS (626)..(790)
gtgccgtaattcattcatctctcagagatatgagtgattcacatgattcacagtcaaacaaaaaagccaccaagcagtatcccactgtgatccctcctcagctggtctgaaaaatacgaattgataaagtatttcatttgaaaacctgatcttgcatgttaaggggctgatgacgaaaattgtaatcaatttcctctttgtttctgtgcttagtttgacaagtgatgggtgaattgagggtagttttttgtcctttttaataaaaaaggacaaaaataatgtgatatttctaacatttttctacccaagtgttgggtatatcatagattagttaaaactcaatcaggaagctcagagaaaatgatttttctctgtttggaaacaaaggaggcacagagcatggatagagataactcattgcacagtgttcagtgagcagaatatgaccatcctagcagcaaggcttctgtgacttcctcagaagataaaacatgctccagtactttacagcctgttatcttgtcatcattgaccccgtttctctcctcactgctattctttaaccaaaggaaagagctcctgagagagacttgaaagtaatggttggaagggtggtttcagtgtaatggatacattctttttctcagaggccaatcccaggcattgtgaaagaaatggcttttcttatgaagacttcaaattttcccaactcttttcacaggtgttggggatgtcctttgcactgaccctgaactgccagattgacaaaaccagccagaccatagggctatgatctgcagtagtcctgtggtgaagagacttgtttcatctccggaaatgcaaaaccatttatagcatgaagccctacatgatcactgcaggatgatcctcctcccatcccttccctttttgaggccctggtctatacaaccagagaagtgggtgtg

SEQ ID NO: 79 - DNA, 835 bp, Homo sapiens
  CDS (361)..(480)
  misc_feature (1)...(835): n = a,t,c or g
cggctgtgngattcggcacgagaaatgggcctcttctggcatctcatgctactctgtgcttttccttgggctccaaattctagctcataaagatgcaagttttgcaatttcctataaatggttaagaaaagagcaagctgtccagagagtgagaagtttgaaaagagaggtgcataagagagaaatgatgtccatttgagccccaccacggaggttatgtggtcccaaaaggaatgatggccaagcaattaatttttcctcctagttcttagcttgcttctgcattgattggctttacacaactggcatttagtctgcattacacaaatagacactaatttatttggaacaagcagcaaaatgagaactttatttggtgcagtcagggctccatttagttccctcactctgcttctaatcaccccttctcccagccctcttctatttgatagaggtctgtccctcagatcagcaatgtcttagcccctctcctctcttccattccttcctgttggtactcatttcttctaacttttaataaacatttaggtataatacattacagtaagtgctatttagatacaaacttaaaacatactatatattttaaggatctaagaatcctttagagaaggcacatgactgaagtacctcagctgcgcagcctgtagccagtttttttaatgtaaaagtaagaatgccagccttaacctagccctgcagataaaagctaacttttattaataccagccctgaataatggcactaatccacactcttccttagagtgatgctggaaaaataaaatcaggggcttcagattaaaaaaaaaaaa

SEQ ID NO: 80 - DNA, 990 bp, Homo sapiens
  CDS (124)..(930)
tttcgtggggtctcctggccccttgacgcgtcaggttgctgtacccctgcattggatgcgctgtaccctgcgctggctccgtgaaccttagggacaacaccgggacacccgcgaggccggaaaatggactcagtggcttttgaggatgtgtctgtgagcttcagccaggaggagtgggctctgctggctccttcacagaagaaactctacagagatgtgatgcaggaaacattcaagaacctggcatctataggggaaaaatgggaagacccgaatgttgaagatcaacacaaaaaccaaggacgaaatctaagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaagggaatgtgggaaagccttcatttcccacacaagtgttcttacacacatgataacacacaacggagatagaccttataaatgcaaagaatgtggaaaggcattcatttttcccagttttttacgagt

SEQ ID NO: 81 - DNA, 1270 bp, Homo sapiens
  CDS (63)..(1124)
ccctccctcatcaccagcagtgaaaatctagagctggagctcagcctctgggaaggcccagcatggaggcagccacagctccggaggtggccgcaggatccaagctgaaggtgaaagaagccagcccagcggatgctgaaccaccccaggcttcacctggacagggggctggcagccccactccccagctcctgccccctatagaagagcaccccaagatctggctacctcgggccctgaggcagacctacatccggaaggttggggacacagtgaacctactaatcccattccagggcaagcccaaacctcaagccatctggacacatgatggctgtgccttggacaccaggcgtgtgagtgtgcggaatggggagcaagactccatcctcttcatccgagaagcccaacgtgctgactcaggtcgctaccaactccgcgtgcagctgggtgggctggaggccaccgccaccattgacatcctggtgattgagaggccaggccctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcaccacggacctcgcccacatccagaaagcagctactgtttacaagaccaaggggtttgcccaacgagacttctctgaagccccaaagtttacccagcctctggccaactgcactacagtcaccggctataatacccagctcttctgctgtgtccgcgcctctccccggcccaagatcatctggctgaagaacaagatggatatccaaggcaaccctaagtacagagccctgactcacctgggaatctgctccctagagatccgcaagccgggtccctttgatggaggcatctatacctgcaaggcggtgaaccccctaggggaggcatctgtggactgtcgggtggatgtgaaagttcctaattgaggacacctaagaaggcatcgtactctgacaaagtgcctccaggaagcccgccagtggtgagactgtgtcctcaaggagcttcggcaccatgtctggtttggattcatctaaataaatatgtggttccccagtgaaaaaaaaaa

SEQ ID NO: 82 - DNA, 968 bp, Homo sapiens
  CDS (763)..(924)
taaggctctaagttaactgctgttagttggaaatattatttttgattttttatacccatagttgtatagttatattctgaacccaccattgttaaattacattctattaaagagaaagagaggaaaaagaaaacttccgaacccaccattgtaaaattacattccattaaagagaaagagaggaaaaagaaacttagtttgctttctgggggattgttgaggtaagacgcctcttagatactgttcttatattctcttcatgtctagattgtagaaattattaaaaatagctatttagggctatactgagggagcggaaatattcttggttaaagtctgtttatcggcaagagcatttggggatgaaggaaataattccttcctatgaatttgctaggtttctggggattggattcaaagagcagaagtatgatgccaggggctggtaaggactcagccatatagagatttcagctgcattataatgtatatttgagaaattgagttcttattatcagaaaattgacctatgtaatgaaatactagaagaaaactctaaattagaatggctttgttatgaatttttaatgataagtactaacacttaaaagggaaaaaatttttcaaagaaaatgcctaaaaatgtgttgtatctgagatcatcatatatgtagtattacagtgcaaacactattaatgttaatgaggtaggtggatttttttaatgaaaaaacttgaaatattatcaggttgtccccatttatggaatttaagcttgtcagaaagatccagatagctatattaatattttatctgtatttggttgcggttgcttttaaaaataagttttcttataagtcatttcaattttttggtttagagtccatatttcaaaataaaaagttaaaaaaagagtaccttatgtaatttagcaaggtattccataaactcagggaggaaaaaaaaaa

SEQ ID NO: 83 - DNA, 1749 bp, Homo sapiens
  CDS (279)..(1475)
tttcgtcaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccagggggcttgtacatgacagctggaatagcctccagttgaggggcttggtggtgctccttatctctaaagcagctgggcccagcagcgtgaacacttcatgtcagaactatgacatggtcagtgggatctactcatgtcaaagaagtttggcagagatcacggagctaattcatattgctctccttgtacatcgtgggatagtaaatttaaatgagttgcaatcatctgatggtccactgaaagacatgcaatttggaaataaaattgctatcctgagtggagactttcttctagcaaatgcctgcaatggactagctctgctacagaacaccaaggttgtggaacttttagcaagtgctcttatggacttggtacaaggagtatatcatgaaaattctacttcaaaggaaagttatatcacagatgatattggaatatcgacttggaaggagcagacttttctctcccatggtgccttactagcaaagagctgccaagctgcaatggaattagcaaagcatgatgctgaggttcagaatatggcatttcagtatgggaagcacatggccatgagtcataagataaattctgatgtccagccttttattaaagaaaagaccagtgactccatgacttttaatctaaactcagctcctgtagtcttacatcaggaatttcttggaagagatttgtggattaaacagatcggagaggctcaagaaaaaggaagattggactatgctaagttgcgagaaagaatcaaagctggcaaaggtgtgacttcagctattgacctgtgtcgttaccatggaaacaaggcactggaggccctggagagctttcctccctcggaggccagatctgctttagaaaacattgtgtttgctgtgaccagattttcatgacatcaaattaaaaagacactattgttagttagctgaaaatcctagggaatgaggttgattgggagcgctttcacgatgcgttaatgacttttaaaacatatgcatttttccttccttttatcacattgctaaatgagttctgctttctttttggaactgctacaaacaaaattagaagaaaaaaaggtcaagcagttttcacttgtcacgccagaagcacacttgaggctgcagtcgcagaaataattaatgagattcgctcctgtgaccc

SEQ ID NO: 84 - DNA, 652 bp, Homo sapiens
  CDS (68)..(550)
tatccgtgagcctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcaagggtgctccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaaatgttattactcctgtaccttctgctcaatttcccttcctcgtccc

SEQ ID NO: 85 - DNA, 4628 bp, Homo sapiens
  CDS (3294)..(4205)
gatcttaaaacaaccagtttctttaattagaaagcaacaaacatgcaaatggcaagtgtagaaatttatttgaaccaacattttcactatgatgaaaattattcttcaacattgatccaagctcccacatttgaaggttagggaaaatattgcactttgcattttctagcactcctcatacacggcaaaaagttttaaaaacattctgctagttttgttttatacaatctcccaaattcatgcacacaatcattccaaaccaatgttaggttatcccaaaaaaagggaaaaactccaaaaaccataaccttaaaattgcactaaagctctgtaaagaaaaaaatataataaatgtcttatacaaatttcagaacatttaagtgcttgccaaaaagagtttattattcctcatcctcattttcattctcttgaccagagccttctgatctgtcaccctccaaccggtcagctcggatatgattaagtgaagccaacatcctcaacatgaaagaggctggaactgtaatggtgtttctagtttcttccagcatgagttcgtttcgagttataacttcatcagcaagttttcggttaaaaatccttgactcttctaatggtgaccagatctttatgtcataatctatgccagatgaggctaaaattgggtcaaacggatgtggctgcaggcagtttaccacatgattatcagcttccagaagcatcaaatgctcagcagtgtgccgatcccagatgaaaatgtggccacagtcagaaccactcattacaaagttagcaccccagaaattggcttcttttatcattgtcctggagttgcgatggcctttataaaccatttttactagcggccttctaatgttcaaagtatccaattcttccatttctttcctttcttttctccgtctgaagaactcctgaatacgggcaacagcagagcgtctatcaccaggtcctgctcgataccttgcacctgggatcaggactgggtcatcatcactgtcatctgtgtcctgaagagcagagtccctggtggatgtttcttcatgagctgaaggcccagtggcttctgtttggaactgaggctcaggattggtgttattttcattggtagcactctcagtgctagtctgatctgaagtttctggttccttggctttttcagatgaagcagattcttctggaaccccacaagagcgatcaagattgaggtcatttctttctcctgagttggaatccaatggcttggctgtgaacttatctgattgtgttatattgatatggttctcaactgggttttctgcagatactccttcctgatattttgtcacatcctctgatgattcttcaggagcttttgtttcactgtctccttctggtggttgcactgagctctgtgggacgaaagattcctcctgaccctcagatttgcaatggctcccaattcctctagaacttgatgctatactgctccattcatctgtaaagttcagttttattgtgcttgtagttgttccttctgtgctgtagtgcaaacttaaaactggttcacctgtccctggtttggggctcagcttttcattattgttatcctgttgctcgtcaagtgacatggatccgagctgtttgttaaccacagaagaaggagaatcagactgatgatgtgtgtggtgtccagatgcctcaacagactgcctttgttcactatctggagaagatagcaaaggagtagaatgagggctttctgtgggagatgatgtcgaatgagcctgagctgacattgtagaggatgtagaaggctgaagaaattgttcagctggagtatctacttccattgcagtttcactcacttccaaatcaggacttgatgggaccgtaggaagagttgaaatatctgattgacttgttccacctctgggtcgagatcttcctcgtcctctattgctttgtgcaacctcacttgcttcttcaaaccatcttgataacatatcagacattctctgcatcaatgacacattgggactctgctctccatctcgttctcgttcactctccggccttgctctgggtccagtatctgaccaatcaccacgaagtctcaaacgcttaactggtggttgtcgcaactcttctcttctctcttccgcagaaggagttttaagttctcgtgctgtatcatctttcgggtcaaaaagatatatgtaatctgaagagtaactaacgagaatctcttgaccatcttcactgtaacacagagatgtcactctgcaggacttattattaagatgggaaggaataaaacgggcaaccattccagtagtccctcgacctgcataattccctgtagctcttgtgcccagcattcgccgatcatatattcgtactgagctgtcagaacaaccaacagcaaggtaatatggtattggtgggcaaatagcaacagacgtggcagcacgtcgacagttaattaaaatatcatctttacaatcttcttttgtgcagctagttttgatgcgtgtatcaaaccacctaacagttccatcttcaccacaagagagaaaagtgtaagggtcattgggtacagtcataatctcataagtagttccataatgacacgtaaattggcattgtctgttggtttctgcatcttgctcaacgttggtataaaatattactccatctccagagcaggatacaatctgtttatcatttgtacaaggtaagaactttgcactaaatatgtttgctcggtgccctgaacgaattgttgtcaaaacctttctgctgtagggattactaattactaatttggtgtcatccgctctaaatgccattaggctttcttccctaagagctaaacagaaatcagccctttcaaaagactccactgctggtataaaccaaccacctgatgctgcccctcccttttgcagttttggcacaattgaccagcagttcttcctgcgacacacttgtttaggagtttcggttctcgctctctgttgcatggtttggtaacaacacttcactatactaaaaatcatcgcccggacctgcagggctgcacggaaaacgctgttccttttggtacccgccgcagccgcgcaggcgcaccgcccagccgccctgacgcaaggcgcaggcttcatgacgcagcacgcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaaaaaaaa

SEQ ID NO: 86 - DNA, 4911 bp, Homo sapiens
  CDS (174)..(1652)
tgcgatattctcgggtcgacgattccgtgaggaaacgaccgcggtcggagggctccggcgtgctcaactttcgaggcggcggaacgtgacccttccgtaccccaccataacatgcccgggtgacctcctcccagatcttccttgtggccttcctcgcccactccagtgacactatgcacccccaccgtgacccgagaggcctctggctcctgctgccgtccttgtccctgctgctttttgaggtggccagagctggccgagccgtggttagctgtcctgccgcctgcttgtgcgccagcaacatcctcagctgctccaagcagcagctgcccaatgtgccccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagctacccaaactaacgctcctggatctctcttctaacaagctgaagaacttgccattgcctgacctgcagaagctgccggcctggatcaagaatgggctgtacctacataacaaccccctgaactgcgactgtgagctctaccagctgttttcacactggcagtatcggcagctgagctccgtgatggactttcaagaggatctgtactgcatgaactccaagaagctgcacaatgtcttcaacctgagtttcctcaactgtggcgagtacaaggagcgtgcctgggaggcccacctgggtgacaccttgatcatcaagtgtgacaccaagcagcaagggatgaccaaggtgtgggtgacaccaagtaatgaacgggtgctagatgaggtgaccaatggcacagtgagtgtgtctaaggatggcagtcttcttttccagcaggtgcaggtcgaggacggtggtgtgtatacctgctatgccatgggagagactttcaatgagacactgtctgtggaattgaaagtgcacaatttcaccttgcacggacaccatgacaccctcaacacagcctataccaccctagtgggctgtatccttagtgtggtcctggtcctcatatacctatacctcaccccttgccgctgctggtgccggggtgtagagaagccttccagccatcaaggagacagcctcagctcttccatgcttagtaccacacccaaccatgatcctatggctggtggggacaaagatgatggttttgaccggcgggtggctttcctggaacctgctggacctgggcagggtcaaaacggcaagctcaagccaggcaacaccctgccagtgcctgaggccacaggcaagggccaacggaggatgtcggatccagaatcagtcagctcggtcttctctgatacgcccattgtggtgtgagcaggatgggttggtggggagattctgccccaggagaggtaatgcacccctgaaggatatgaggggatggaagagagggctggctgcccaagggaatggattcctcctgacctcaagggaattggtcccaggtacaacagagagcaagaccccaaacagggcgtggctgccacgattttcaaatgggggtatattaatcctcaggcaaatgctacacccgtacccaactaagccctgccaattctcagtgtggtagaggaagagaagcatgtctgagttggatgggaatgaggaaggagtgaggggaagaacagattccctaaactttcatgaggtcatccctagctccttaagagaaaaacatttagaaaaaaaaattttttctatctctgcccacccacacctgtgatgttgtgtgtgttgggggagcttccacaggagccacactggggaaaagctgtagtatcttctttgtttagcaagtcaaacttcacagctggggaagttgaaaacctttggaaaatgagtcaggaaaaggctgagacctcaatcggtaacaattccccaaagctgttgtaagactttgcattaaagccttcctttttcctgatgtgccctgggtggatggatctttgcaggagcctggcctgctgccttttagttacaacagcaatgtgggatgtggtatctgtgccttgtcctgggaccaatggcacagagggttatagcatgaactgaagggtccatgtcacagcataggtgccagcacgaaacttgtagatggggggtgaattccagataggctaattccctggttggtgaaacccttggttagtatttgattcccagcatctgtgtgtcaggccagagtgggggctgctgaaggcagagcttttatggatgcctgccacagacgtggtacatgggcccacttcacgatagaaggatgaaggtaaatcagcctctattatgtagcatccagctggacctagctgattctcaatgtatgccatctcttcatccagtctccttatcaagctcaggtgggattctgaattttccctaatatgctgctctgtaaagggaggagtccaagaaagcctggccccagctggcttagagtaggcttggcgatagtgaaaatccagtatatatctcctctgtgtggacaaggttgccttgctcctctcagagataccacctctgctgcaaagtcaaagcatggggttttgacatcagaagggttggaattgggtggtctctaccccagaatggcaatttggagtgcagcttcaagttctgccctctccacagattccaggcaatcctgaagcagagataatcagtagtactaaactttcagaaggggagttctgccaccccattcctccatcgagaggtctttgcagttgtggttgtgaggccagaggaacttaagaagaatgagctcaacattccattccatccaaggttgcagaatactttgagtatggagatgaccgatccctttaacctttccctttgactatactgcatgccctgtgagtggctgctctgagctttggcgggggatgagcagggtgaaggtgaaaatgttctctgatgttggtttttcttagtgtctcttctctcccacgtttctagtccattggaagttctccagatcctctagatttctgacctctttttacattctaagaggtgtcatttacctgtgggtgaggggcttggagggcctgactattaagcttcctattatgattggggaaggggactcaacatcttccccttgtctggtcctgggaactcaagactgctgtccatcctttattagtaacctagttttgttgagagagaggtgcagcatttccctcaagtacctgcatgctcataggtatgcatgcttataggtatgcatgcacaccagcaccttgacttccaccaggacagtgaatctgtagtccccattaatgatactctcagaatggtctccaccaatgtgcacaacttcatgcacacaattgtattcctctttaggagagacagtgaccatgccaggctcttcaaatacacactcctgtattttcatttctgaactccctgaagcttcacccacatctccatggcactgaatcacttttctgcccaggctggagttagaagaaccatgggttgaaggccttgggagaagaggtggtaaggagctacctggttctttggactcctcagaaacctcccgtgaagactatatatatgagcaatatatgagcaattaagatagaactaggtcattgaacggactcagaaggaaactggcaaggggctaagtagctgtgagctgctcttcctgttaaccgtcctcaggagagacccagtgtcttgatttattccagagactcctgagaattttgttactggagctataggaactaggactccctcctcagactcatcaggaaatctgggaaaatctcatctccatgctgcagtctccccgcttggcaccatctagggctctgaagatctttaaagtgagcgttaaatgaagcaggccttctggggcatcgtgatggagctcctgaggactgggagggccgttttcttcataattcctacccagtttagggaatgagaaaaggccctgtggctcttaagtctcctgactatatccactagtttggccttgagtttgagacacctggtagatgtacctggctgccctaccaagagatttgatttgtttcttcccgtggtttcaggtgatagaacccaaaggtagctttttaattggagaattgaataatcagcatatgtaagcgcactagaaccctgtgttgaaaactgccaggtgtgggtataagaaaaggccgagagatcaccacctcctcttaccctaccccacacccataaaccagacatgtctcccaggaagcaggtgtccctggacacagaggatgacagggctctacaatctgtgtaattattattattattattattttgtatttatggggcccaagaaaggggccaggagagggtacaccccagctggggagagcaaagcagatggatccagttttctgtgtgttcttacctctgtacttcctcgtagctctgctgacaaagcaagcaggcctcccgtgtccaagaccccattcctcccacttgtgtacacctaggctggcaaatcttggagcctctgggctctgaaaactagacaatgatcattaaacctggcttgagtctctgttctggc

SEQ ID NO: 87 - DNA, 2480 bp, Homo sapiens
  CDS (462)..(2153)
ggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgcccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtacagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgacctggaggaacttgctttgtaccagatccagctgctgaaggacctcagacatacggagaatgaagaggacaaagtcagctcctccagcttccgccagcgaatgttggggaacctgcttcggcctccatatgaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacagatattctccataaagatggcatcatcaacaggaaggtcctaggcagccgggtgtttgggaataagaagcagctgaagatactcacggacattatgtggccaattatcgcaaagctggcccgagaggagatggatcgggctgtggctgagggaaagcgtgtgtgtgtgattgatgccgctgtgttgcttgaagccggctggcagaacctggtccatgaggtgtggactgctgtcatcccagagactgaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgagaaaaaaaaaaaaaaaa

SEQ ID NO: 88 - DNA, 1662 bp, Homo sapiens
  CDS (228)..(635)
gggctgtccgatcgaggccgggcgttcacgggcggccaggcttgagtcccgggtcggggccgggggattgccggcgcatcagggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggtttccctattccaatcctgtttgaaatggtttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgaactttggtttgatgccagtcaggtgccacatgagaacctttgctgagatgcaaatgggaagcttgtgagtggcccatctttgttggcctacgaactttggtttgatgccagtcaggtgccacatgagaacctttgctgagatgcaaataaagtaagagaatgttttcctgaaaaaaaaaaaa

SEQ ID NO: 89 - DNA, 546 bp, Homo sapiens
  CDS (66)..(269)
attagaataaatgttgttgccaaatgaaaacatgacactgtatataactgctgaggcctattctcatgtttaaccttcctaagccagttttcttaagttggtggagatggaagactatagtaattttcctagcatgtctggcatctgctgctataaaagagacagcagtaagcatgaagactgtgtttcccatatttgtccaaatcactttgattttgcttttagagtcaagagtcttaaaaattggtgatttttccaattttttctgctaatagtatatttaaaaattagcatatgctttaggtacatgaaactttaaaaaagtaattataatgtacagttaaaaatttatagtaagtggatctcacaattcattttctaattagtaattgatagttttacccattaaaatgacaatgaaaatatttttactatgggttttcctcccatttgtttctaatcatacctttgataatattttataaaggcttataatcatagcagggaattaatttactacttaaattttatgtatatgtacagtac

SEQ ID NO: 90 - DNA, 1889 bp, Homo sapiens
  CDS (366)..(1334)
ggacaggactctttttgtgacttccgcagctgacacacttgccttcctataatctggtaggagtcacaggatacgcagtgatggtgcagctctctctcagggaagacaggtacaggtatacagacctctggtgctcacatttaaaatactgaaatcctcccaatattgttttggggcagccaggttgatccaatcctccatttgggtagaagtctatgtttcctaatggctccttgtagcccagtgcatcagtgtcggaatggatgacatcaacaaactgcgcatcactgggatctaatctgtcttggtgaggtttcccgttgaataaggctgcagggtcagagtgcctgtaattctccccagccatggtcttgaaggaatttattgaccagatgttggcagaaggagcttctcttgatgacatttacatgatcggagtaagtctaggagcccacatatctgggtttgttggagagatgtacgatggatggctggggagaattacaggcctcgaccctgcaggccctttattcaacgggaaacctcaccaagacagattagatcccagtgatgcgcagtttgttgatgtcatccattccgacactgatgcactgggctacaaggagccattaggaaacatagacttctacccaaatggaggattggatcaacctggctgccccaaaacaatattgggaggatttcagtattttaaatgtgaccaccagaggtctgtatacctgtacctgtcttccctgagagagagctgcaccatcactgcgtatccctgtgactcctaccaggattataggaatggcaagtgtgtcagctgcggcacgtcacaaaaagagtcctgtccccttctgggctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcccgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcc

SEQ ID NO: 91 - DNA, 1526 bp, Homo sapiens
  CDS (772)..(1206)
ccaaaacaagcttaggagatttttattctttaccagaaatgatatggcttgggaggaaggtgtgtgcattacacacaggttgctctgtggtcactgctccttcatactgtgtttctgcctctgcctgaacccaaacccctcccagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatgtaagaaaaatgcacattctttgtgaaactaatgtgtacccactgcttcttaattttttgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccata

SEQ ID NO: 92 - DNA, 1365 bp, Homo sapiens
  CDS (349)..(609)
cagtaacttcatggacttttaagtgcgggatgaaatgcaacattacgcttacaaacagtactgtcaaacctcaaatgctttctttcttcagatgctttttcgtgtacatgatactagtagacacttttctctttatatttaccgagagggaaaaccatacgcaataaaatattgatgtttgaaggcagtggtcaccaattggttaaaaaactatgaaatgtaaaccgaaatggtatatctctatcctttttgcttttctctgggtttttaatgtatggaataaatctcataaatagaaagaaaaataatctagaaatttttcaaagctagtactctttctccttataaatgtacacaattttaatctttttacaaatttatttaactgtacctactgtacttattgtagattcaatgacgcagttaagtcatcacccaaggatttatgaatttgagattactgacctgttttcttcatattgcattcacatcaatatttgtgaatttgttgttcagcttttcattcaaacaaaaaatattccctcaagaaagctccatttttatcataaacatttcaacataaccaacattagaacaagtctgccatgttaaaaataatttaaagacttatctctgaaaacggtatccagaaacgcaggtgttcccagtaatgtagcttcaaaaataaaatgtgctatttatatgacatgaaattcataacttttggaagggtatatttatgacagcataaaaaataaattctgtgctataaagaagatccaacaaattaaccatataagcacagaaagtagagaaacacagttattgaatctactcttgtcattaacattttcaaaaaacaaaatgcatattgtaatatttggtacatgacacttgcatgttgatatgcctatatacttacaaagtattcaatgtgtacttagcggcgcttaaaatatgtcatgtacaactcttataaacatttttacagggttcccatttgcacttcatctttcagtaaagtcttgtcagaaaaaaattgtctgataaatatggaaaaataaaatttgaattttagttatctgttggacattactgaattgtctattcatttagtacattttcttaaccttgaaaacagacgttgaaagatggaactttcttttttccagtgacaggtcattaaatcgatggtacaaaacatacttctttatgccaaacacattattttgaatacctttttttcaacttcatacattatccatccattttagttttcctcgatgatgcccattttctttgtaaatttctaagtggaagttttaaaaattatagcatcagtaaaataaatgttatcttatttgc

SEQ ID NO: 93 - DNA, 1175 bp, Homo sapiens
  CDS (553)..(702)
  misc_feature (1)...(1175): n = a,t,c or g
gcaattcttgctgcctgtgggtcctttttctttcatggagcctgctgggtcttgtctcacctgtgctgagctcctctggggttttgatttcttccttccttatcaggccctttggggtaagcctgctggttgtacctgacatagggaggcagttaggggcagtccctggtggggccgccctggcagcctccagctggcaccatcgtgtgcctggtttccctgcaacacctgcctctctgtccctgctgctgcttggctcaagcccaacaggcagcgtgcatggaggtggttacacacagctgtttccgtgagggtgaccgtgtctgcagcacgcttccgtctccgcatgcacggctgcctctccagccacctctgatacttctctcttggggccatcagagcctcccttgggctgtcacctcccagctcacacacactcttcagtggtttcctctcttcattctcttatagggcgtggtccttcttatttatctaaagggctgaatttaggagactttttacccaggggcaaaaggctcttagggtaatgagatggatggtggcccaggtgcattttccagggcctgggttctccagatcccgtggcttctgttgagtggaggcaactttgctctgtgtgaacctcgcccctgtccctctgccgggcacccctggcaggaagcaggactcccatcctcaccctgacttagactgtcctctgagtcagctcctctccaagacaggagtgggcagccctgggcagtcttctggccccttgctaaagtgaagggaaggaaagctggggctgccctccaagaagccggggtaaggacttctgaaaattacttctctaaacggaagcagggctcttcagttccacttggcgtccccctccataagggccttcctcactganggaccccacccccgtatccgttccccagcagcctttggaccttaactttttccgtggtcgtggggtctcagcccaggggaacttgaattagggggattggaagggcagccaaaggtaacagctccagaaagagggcctgcaacccaacctggttcttcaatccctgggattaacttggaaactgattgggttttggtaaagttggtttggtggtggttggtgtttgcatggnggtaaaggaatgtgaagggagtgtgtg

SEQ ID NO: 94 - DNA, 1052 bp, Homo sapiens
  CDS (365)..(508)
gccgggagtggacgccgccgaggcccggagtcgcgcctgcagacacagcatctactcagcgtgggtcacctctgtgaacatcactgactgcaagcctccctcaatttctggtgcagcccatcagggacccacagcgcctgggaggatggtgcggatcttggccaatggggaaatcgtgcaggacgacgacccccgagtgaggaccactacccagccaccaagaggtagcattcctcgacagagcttcttcaataggggccatggtgctcccccagggggtcctggcccccgccagcagcaggcaggtgccaggctgggtgctgctcagtcccccttcaatgacctcaaccggcagctggtgaacatgggctttccgcagtggcatctcggcaaccatgctgtggagccggtgacctccatcctgctcctcttcctgctcatgatgcttggtgttcgtggcctcctcctggttggccttgtctacctggtgtcccacctgagtcagcggtgacctctgagggctgataggggtgggtttgttgagagggacttgctgggccttggtgtgagagcaggcatatttggaggggatctggtggtgccttgaaggtatgatcagagaggggaccacaggtgtgtgcttcccctttgtgttaagcgtgaggcagagggagacgttagtccagcatttccaaagtgtgggtgggtccgttggttccccaaaaacttttaggtggtatggggcctgcattaagtggcccaaaatcagagcaagaaagcgatgcccttcccaattctctcaatccttttatgccgaaaagatttcagctggatgccaacatgttccgatgcctgtggaaaacatgccgacgtttcctctgcctagggagcaggacttgggcttagggcaggtggaaaaaattccagacttttttagccctgttttttttttaatgggatatttttattggcccctttattgtttaggacaagtggtaggggccttttatttattgtgcccttttcaataaatagatttaagtaaaaaaaaa

SEQ ID NO: 95 - DNA, 1968 bp, Homo sapiens
  CDS (415)..(1872)
tttcgtgggtgccctgccgaagaggggaagatgcagcgagggagagacctagaaccgcgatcaaagctgcagcagctgctggggctggcggcacaaagggaggagggaggagcctgggcgctgagaaagttcttggggaaagttgagctgagccaagagtcgggcggtggctgggatgggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcctggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgtcaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctccc

SEQ ID NO: 96 - DNA, 1309 bp, Homo sapiens
  CDS (1)..(756)
atgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaaaaaa

SEQ ID NO: 97 - DNA, 1274 bp, Homo sapiens
  CDS (21)..(233)
agctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaaaa

SEQ ID NO: 98 - DNA, 2058 bp, Homo sapiens
  CDS (276)..(1871)
agtcagctggggtgtcctccctctgctgagcctcctccccctgcggccttcgccttggccctcggtgcactgcatcggtgtgccaactgctcactgtgcacagacctttttcatactgatgaattcatgtttattactttttaaaaagtttatttcttggatcttagtcacagctaaccctgattttgctttcagtacaaggatttttaatttctagaccggatttgagttgtttgaacggaggtctggtggctttgggaaaggtctttgcatggatgatgggggaaggtgcctttttggtgagtgccatagtcggctgccaccttgccatccagagagattcctgcttgtggacactgttcagttatgcaggacgttctagtacacagcagggactctcaactctcgcgctcagacgttctagtacacagcagggactctcaactctcgcgctcagacgttctagtacccagcagggactctcaactctcgcgctcagacgttctagtacacagcagggactctcaactctcgcgctcagtcgttctagtacacagcagggactctcaactctcaggctcagacgttctagtacacagcagggactctcaactctcgcgctcagtcgttctagtacacagcagggactctcaactctcaggctcagtcgttctagtacacagcagggactctcaactctcgcgctcagtcgttctagtacacagcagggactctcaactctcacgctcagtcgttctagtacacagcagggactctcaactctcacgctcagtcgttctagtacacagcagggactctcaactctcacgctcagtcgttctagtacacagcaggtactctcaactctcgcgctcagacgttctagtacacagcagggactctcaactctcacgctcagacgttctagtacacagcaggtactctcaactctcgcgctcagacgttctagtacacagcagggactctcaactctcgcgctcagacgttctagtacacagcagggattctcaactctcacgttcagtcgttctagtacacagcagggattctcaactctcacgctcagtcgttctagtacacagcagggactctcaactctcacgcagggactctcaactctcgcgctcagtcgttctagtacacagcagggactctcaactctcaggctcagtcgttctagtacacagcagggactctcaactctcgcgctcagacgttctagtacacagcagggactctcaactctcacgctcagtcgttctagtacacagcagggactctcaactctcacgctcagtcgttctagtacacagcagggattctcaactctcacgctcagtcgttctagtacacagcagggactctcaactctcacgctcagtcgttctagtacacagcagggactctcaactctcacgctcagacgttctagtacacagcagggattctcaactctcacgctcagacgttctagtacacagcagggactctcaactctcgcgctcagacgttctagtacacagcagggactctcaactctcgcgctcagacgttctagtacacagcagggactctcaactctcgcgctcagacgttctagtacacagcagggattctcaactctcacgctcagacgttctagtacacagcagggattctcaactctcacgctcagtcgttctagtacacagcagggactctcaactctcacgctcagacgttttagtacacagcagggactctcaactctcacgctcagacgttctagtacacagcagggactctcaactctcacgctcagtcgttctagtacacagcagggacctctcaactctcacgctcagacgttctagtacacagcagggactctcaactctcacgctcagacgttctagtacacagcagggactgtcaactctcacgctcagacgttctagtacacagcagggactctcaactctcacgctcagacgttctagtacacagcagggattctcaactctcacgctcagacgttctagtacccgcgcagagttc

SEQ ID NO: 99 - DNA, 1366 bp, Homo sapiens
  CDS (45)..(956)
tcccgggtcgacgatttcgtccagccgcattggaggaacgggctatggaaaaattgagagaaaaagttccatttcagaatagaggaaaaggaacattatcatctattatcccgaataactctgatacaagaaaagcaactgaaactacttctctgagtagcaagcctgaatatgtaaatcctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcatgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattgggtaagatgctttttctctattattattacttgctattattttctcaaatgacaccacaaagctagtttgtttcaaggagttactggttagcattaattccttgtaagttttgtgcttcttcctaaactgagaacaccgtgtatttctgtgcaagcgtccctaaagttggcttagaaaaacgctacacttatgcaggtgacaggctgcctatggctctgtcttccttatctctcttttgctctgccattccagttttgtgattatttcccctaggaaatgtccagtttagaattgaatcccagaatgagtgagtgcctccaccttgtgagtctctgggtggctgctgtgggtggagaggcagcactctcgggtgcatttgtgggggcagcttctctcgggagctgtgcttttactgacaggtgcacacggccatggggtgctgtctttttgccctccgagcaacttctgagtg

SEQ ID NO: 100 - DNA, 1336 bp, Homo sapiens
  CDS (71)..(631)
attgctgcctggtgtgggaaattatgagtcttattttctgtttattctttttacaagccgagcttgggtcatggcggcgccgggcgcgctgctggtgatgggcgtgagcggctcggggaaatccaccgtgggcgccctgctggcatctgagctgggatggaaattctatgatgctgatgattatcacccggaggaaaatcgaaggaagatgggaaaaggcataccgctcaatgaccaggaccggattccatggctctgtaacttgcatgacattttactaagagatgtagcctcgggacagcgtgtggttctagcctgttcagccctgaagaaaacgtacagagacatattaacacaaggaaaagatggtgtagctctgaagtgtgaggagtcgggaaaggaagcaaagcaggctgagatgcagctcctggtggtccatctgagcgggtcgtttgaggtcatctctggacgcttactcaaaagagagggacattttatgccccctgaattattgcagtcccagtttgagactctggagcccccagcagctccagaaaactttatccaaataagtgtggacaaaaatgtttcagagataattgctacaattatggaaaccctaaaaatgaaatgacaatgattttgtatcagtggtccaaacagaactaagcataaatcattgtgccatcccaaacctcgttccagccgccttgcccatactagattctaaatgtttctaaaggcaaaccccaatgtgtcaagacagacttgtttaggtgtaattttaggaattatgctggttcatcaggaagcagagggggagttttaaaagtcaagcttaaattgaagtttaaattcatctataaccaaatcaaatgatcagaggaaattctgtaatcaatgctggaaatcgttacattgtttagaacattcttgctcatgcctgtatttgcacaaataaatgaaacttcgctgtccttggcattccctggaaattgatgttgggagtataaacatgtacataatctacccaccacccagcacaccacacacctcctaatcctctctctgtcctggagctgtggttcagaatagtggctcttaagctaaggtctcaaaaggtagtcattgcagaacaagcaaactttgttcagttccttaaatggcataatgcaaacatacttaccagtagcaataccaagcttcttgccttttgcctaaaattatgtcaactcaaactgtctctgctgatcaccagctctgtgctgagtggttgtgtgttatgtatctgtgtgtaatttaaacgtagaaacttaactgctacttaaaaagcaga

SEQ ID NO: 101 - DNA, 3450 bp, Homo sapiens
  CDS (1)..(2940)
atggggagaagaaagggtaggtctgcgctgagccggagtagtttggaaagggtgaatcagggagaggttaaagtgattggaaggggagcgagggagggcggtggggggcaggcttggggtactgggggggggggcagagaccttagttgcgggatcccgcgctcagcgtcgcccctcgcgcccctagcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgtccccagtgcagcaccccagctctccctgtccagccccaacccttcggacatcagggtggcgtggctgcccctgccccccagcctgagcaatgggcaggtggtgaagtacaagatagaatacggtttgggaaaggaagatcagattttctctactgaggtgcgaggaaatgagacacagcttatgctgaactcgcttcagccaaacaaggtgtatcgagtacggatttcggctggtacagcagccggcttcggggccccctcccagtggatgcatcacaggacgcccagtatgcacaaccagagccatgtcccttttgcccctgcagagttgaaggtgcaggcaaagatggagtccctggtcgtgtcatggcagccaccccctcaccccacccagatctctggctacaaactatattggcgggaggtgggggctgaggaggaggccaatggcgatcgcctgccagggggccgtggagaccaggcttgggatgtggggcctgtccggctcaagaagaaagtgaagcagtatgagctgacccagctagtccctggccggctgtacgaggtgaagctcgtggctttcaacaaacatgaggatggctatgcagcagtgtggaagggcaagacggagaaggcgccggcaccagacatgcctatccagaggggaccacccctgcctccagcccacgtccatgcggaatcaaacagctccacatccatctggcttcggtggaaaaagccagatttcaccacagtcaagattgtcaactacactgtgcgcttcagcccctgggggctcaggaatgcctccctggtcacctattacaccagttctggagaagacatcctcattggcggcttgaagccattcaccaaatacgagtttgcagtgcagtctcacggcgtggacatggatgggcctttcggctctgtggtggagcgctccaccctgcctgaccggccctccacacccccatccgacctgcgactgagccccctgacaccgtccacggttcggctgcactggtgcccccccacagagcccaacggggagatcgtggagtatctgatcctgtacagcagcaaccacacgcagcctgagcaccagtggaccttgctcaccacgcagggaaacatcttcagtgctgaggtccatggcctggagagcgacactcggtacttcttcaagatgggggcgcgcacagaggtgggacctgggcctttctcccgcctgcaggatgtgatcacgctccaggagaagctgtcagactcgctggacatgcactcagtcacgggcatcatcgtgggtgtctgcctgggcctcctctgcctcctggcctgcatgtgtgctggcctgcgccgcagcccccacagggaatccctcccaggcctgtcctccaccgccacccccgggaatcccgcgctgtactccagagctcggcttggcccccccagccccccagctgcccatgaattggagtcccttgtgcacccccatccccaggactggtccccgccaccctcagacgtggaggacagggctgaagtgcacagccttatgggtggcggtgtttctgaaggccggagtcactccaaaagaaagatctcctgggctcaaccaagcgggctgagctgggctggttcctgggcaggctgtgagctgccccaggcaggcccccggccggctctgacccgggccctgctgccccctgctggaactgggcagacgctgttgctgcaggctctggtgtacgacgccataaagggcaatgggaggaagaagtcacccccagcctgcaggaaccaggtggaggctgaagtcattgtccactctgactttagtgcatctaacgggaaccctgacctccatctccaagacctggagcctgaggaccccctgcctccagaggctcctgatctcatctcgggtgttggggatccagggcagggggcagcctggctggacagggagttgggagggtgtgagctggcagcccccgggccagacagacttacctgcttgccagaggcagccagtgcttcctgctcctacccggacctccagccaggcgaggtgctagaggagacccctggagatagctgccagctcaaatccccctgccctctaggagccagcccaggcctgcccagatccccggtctcctcctctgcctagctcttcccagaggatgtggtttggggcaggcaggtatggatcacataggatgcgatacctgtggccgtgtatgtccacatgtgtgcctgtagatacatcatcaagccctttggagcttcctaagttgctttggctgaggggagaggaaaacatggattattcactccccccatactctttgtgatacacatgtgacatgtgaaagacatacgagacatagctacatgtgatgtgcacatgtgtgaagtgcatgtatgcgtactggttgttgagctgggaaaccgtggcccaggcagtggtcactacagcctgattggtcctccaggtcagaacggtgccccacagtggtcagtccccagccctgtgggcccccacctccattcgcccagccttttattacacactctgagagtgtctccaatgcctgtcttgacaaagacagttcccagcccttgttctgttttgggtggggttgggtgcaagcaggtatttgattggtggggtttt

SEQ ID NO: 102 - DNA, 845 bp, Homo sapiens
  CDS (1)..(531)
atggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggcctggatgccctcaccatttcttcctcatacacctattaccatacaggggaagtccccaagctctcctgtctcatagacactcacccactggcagagcattcttggctgattggtgggaagttccagcaatcagcacaagtgttcttcataccccaaatcactaaaacatatagaggggtctatgtctgtttcatccataactcagccactggtggaacaaatctcataatcaagaggatcatagtccctggtaagtggatccctggagcattggcaccatgttttccagtaaagtctatctagctgtcagggaagagccacctgctctctgcaaagggagagggaaaatcaaaacccaggaaagggaatatgtttctgctccaaaaccaccagcttctgcctgtccccttcactctttctagatcattctttagacaatacactaacaatgaacaatctgaaaggaagttaaggaaagaatttcaattcacattaacatcaaaaggaataaaatattttggaataagtttaaccaaaaaggtcaaatgattatacctttaaaaaaacaacaaattgctgaaagaaattaaagacaaaaaaaataaaaaaaaaaa

SEQ ID NO: 103 - DNA, 711 bp, Homo sapiens
  CDS (12)..(359)
acgtcggggccatggggctgggcccggtcttcctgcttctggctggcatcttcccttttgcacctccgggagctgctgctgagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaagctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcc

SEQ ID NO: 104 - DNA, 1402 bp, Homo sapiens
  CDS (251)..(598)
acacttacggcacgatggggcatgcgtcagttacctccgtggacatggtggaacttccgtggatatggtcgtcctgtccctgtacctggcagccttcgcactgcgcctcctcctggctgggcttgcccccatgcactgccgggacgcctcccaagcggctgcctgccactatttcaccatggctgaatgaagcgagtggcacaccgaggatccccagttcttggctgaggtgctcttcactgccaccagcatgctcagcttcacccgcctggcctacattctgccggcccacgagtcgctgggcactctgcagatttccattggcaagatgattgaagacatgatccgtttcaatgagacgtttcagtttctgttctggaccatgttcggtatggaagagcacagcgtggtggacgtgcctcagtttctggtgcccgagtttgcaggccgggccctctatggcatctttaccatcatcatggtcattgtgctgctcaacatgctcattgctatgatcaccaactccttccagaagattgaggatgatgctgacgtggagtggacgtttgctcgctccaagctgtatctgttctacttctgagagggcctgacactgcctgtgcccttcaacatcctgccctcctcgaaggctgtcttctaccttctcaggagaatttgccagttcatttgctgttgctgttcctgctgcaaaaccaagaagccagactatcccccgatccctacttttgccaatcccagggcaggggctgtgcctggggagggagagcgtggatcctaccgccttcacgtcatcaaggccctggtacagcgctacacagagactgcccggcgagaattcgaggagacccggcggaaagatctgggcaacagactcacagagctgaccaagaccatatctcgactgcaaagcgaggtagccggtgtgcggtgaactctggcagagggagggacaccccggcctcccgacggtgccagcgtcctcagtcactacatcactcaagtgcacaacagcttccagaacctggggcctcccatccctgagaccccagagctgacagggcctgggattgtgaggacccaggaatcatcaggaaccgggcttcaggacactggaggggtgaggactctggcttccggagagtctggcccctgctccccagctcatgtgctagttcatagggagcaggaagcagagggggctggggacctgccccagggggaggattcggggactgagaggaggtcctgatacagtggaagagtcccttcttctgttgctgagcgtggtagcctaggagggtgagggtggggggccccttgggaggagcctgtgctgcttttcttgcttcaataaagtttctgctctggaaaaaaaaaaaaa

SEQ ID NO: 105 - DNA, 1786 bp, Homo sapiens
  CDS (122)..(838)
acctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccgtcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgagtcctgctctgggcagggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagc

SEQ ID NO: 106 - DNA, 887 bp, Homo sapiens
  CDS (237)..(410)
tgtggagctctgggttgctcttagtactgctgccagaaacactgttagaatggcaaccctgccattctcccctccagtggaagattctactttattcaggaaggctggtggcttgcaggggctaggcttacacaagccagccaagattgagaaggtaggggagtgctttcaatggaggccatagttgtcatcttttcttctgagcaggctctaggacaaacaatgagcaaattgagatgtcctgtattgggaggatgaggctgatatgtttcatcattctcagaatttgggggctagagcacctttttgggaatatgggcctagggaaaagaacggtcacttacctggacactatggccatagtcttgagtttttctagtcagcatgtgattggttgtaccttaagtttatgacaccaaaaatactattaactctgttatttttgttcttaatcccatctcaaattagtttctagagttagaatcagaacacaaggatgctcattttcacatggagggaaagttgccaaagcatttaaaaaataaccccaaaagtatatctagcagtgaagcttggtagataaaggtgaactgctaaacagacactggcgtgccacactcctgccagggcagtctcattgtgtgtgacggtgctgcaacactgccagtattacttgagatgcagtctctctcccctgttctcagttcctgggctcagccctcctccaaggcctgccagtgagtagcagtttggaaggcaggccaagggagatccccaaaagtttaagttactctggtgggtcccgcaaaaatttaacggccaggttttaaggacacttagtggttagaaaacagcgtgagttaaatgttcccacctcggcaccggtg

SEQ ID NO: 107 - DNA, 689 bp, Homo sapiens
  CDS (63)..(242)
tcagaatttcttttaatgctacacatatataagcaaataatgtttttaagaagctaaccttgatgttaagagtggcaggtgttctccagtttttacctctttcatatgggaccaaagtagctagtttatggaacacatatgaaaatgtggttatgccaccaagttttactactacacttgtcttaccacttttaagtcatgaattctataattattcatacccctttgcctgtgatcagaagtaacttttaaaattatcacttgactttggatggaactagtataaaggcaggaattttgtctttcagtggagatttattctgttcaaggttgaagtggacacatcattatcttgggatggtacttctttatttaaatagtcctttaaagttctttgagtggcagagaacgtttttggtttcagtctgagaaggctaccaaatggtttaagttcatttcatagttaggagaaaaagattttgagtagtctaatgtcgtcagaaaggattaaaacgttgtatgtaccaagaaggcagaatgaagaaggatcacgttcacaaatgctgtatgtttaacaaaatacgtttagatggtaatatccaatagtcttatcaagtgctacaatctttttaaacagggaatggccaaatccagtgctattgaaacagcctgaagaatgcaatcttaat

SEQ ID NO: 108 - DNA, 1813 bp, Homo sapiens
  CDS (814)..(1161)
gcttgcgacgaggaaaggaatatggaaccagtatgaattaaaatttgtgttttcttcaacattccataacatcactaagaaataaaaaattataaaagctacatggttaaaaagtaccatgctggccaagcgtggtggctcatgactgtggtcccagcactttgggaggctgaggtgggaggaaggctggagcccgggagtttgaggttgcagtgagctgtgatcacaattgcactacagcctggacgacagagtgagaccctgtctcaacaaaaagtacaattgtttgaaagaatgtatacatgttttttactttttagtgaaatatattgtttttaaacattccttggtagagagaatttttttgttggataaaagggaggtatttttgttaaggatatctgggcaccctaaaaatttcatactttatgtccactcattaccgtatgggagaaaagttgctaccataaagtatgtggtttgtaggagctcctaaaataaaactcttcagttttccaccctgaagtcagcttttggtcataccagattatgtacatatgtagtgggttcatgccatacttttagaaggccagcagagggagcactactcaatgtacagtgtttactgtactgctgagaagactagtattttctatggctcagtacaaaatgaaaacaaaattaaatttcacaactcctcaaaacaaaaccaaaacaaaatttttcattttattcgtgggttcaggtttcagacatgctatttattagtgactgagcagattattttatttctgtgtacttttttgcctatatatgaagactactcaattaccctattttagagggttggtttgtttgtttgttttgcggcagggtctcactttgtcgtccaggctggagtgcagtggcatgattgcagcttgctgcagcctcaacgtcccgggttcgacggattctcccacctcagcctcccgagtagttcggactacaggtgtgcgccaccacacccagctaatttttgtatgttttgtggaaatgtggtttcactatgttgcccaggctggtcttgaacccctgggctcaagtagtcctcctgctttgtcctcccaaggggctggaattacagatgtgagccaccataccccgttagagttgtgtttttagatttttaagttattatggatacatcctagttgcacatatttttgaggtagatgtgatattttgatacaagcatataatatgtaatgatcaaatcagggtaattggagtatccattgcctaaagcatttatcatttctttgtgttgggaacattccaattccactgtcataattgttttgaaatatatagtaaatgattgttaactataattgccctatagagttacgttgtcagtcctacttagtggccctagcaaagaggaagaaacatagtaatttacgcaaattcccggtggaaaattagagaaagtttagagaactaaattagtgtaaaacttaaaagtatttctgactataaattctaccattaaaaacaaaaaagcacccgtgaacccacaaggataaaataatgtgtttgtccctgcccttccttgcatatcctgggtgaggctggttgatggtacattgttgtagaataattgcggaattttatttacctggaagtttgctgagaaaacaatgtctgaggtggtgtaagtttttggaaagcaaacatttgacagagttctcataattgattttcattttccaccctttattctgttaaagttctgaaatattgcataaggccattctgaaaaaaaaaaaaa

SEQ ID NO: 109 - DNA, 1508 bp, Homo sapiens
  CDS (191)..(1321)
gggcaggaaagcgtggctgtgttgagcagaacccggtgcaaaacggaaagggtcaaacactttggccaagaggaggatatccagaaaatccaaatgcctcttcctcttgatcttctccagctccccctccttctgtagttgagccttcctcagttggatcacttggtctgtccacctggatgctgccctgatggctgaaggcacacttcatgatggtgtccagggtcatcaaggagacgtgctgaaagacctccagaggggaatcctggccaaggagctcttcccatttgtcctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttggtaagatctgcacccctaaattttcctgctagttttccccctgagattttgctttattttttgcgctggtaccttagtgaccctagtgcctcaggatatgtgtaggtgaaacagaagaagtaggctacttttctgttctttctaaagagagctccaaattattctcttgtctttcaggaaaaaaaaaa

SEQ ID NO: 110 - DNA, 830 bp, Homo sapiens
  CDS (164)..(649)
tttcgtatttccgttaggacatcgctgaaacacagactgggatcaaactgtgctcatagtcctaaggatctccagcaccctgccggtggcactactgagagacgaggtgccagggtggttcctgaaagtgcctgagccccaacttatcagcaaggagctcatcatgctgacagaagtcatggaggtctggcatggcttagtgatcgcggtggtgtccctcttcctgcaggtctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagttttctggtattttgtcaaccctgctctgtctgagccagcggaatatgatcaagtggccatgtgaattccaaatatttttaatggggtccagttctctatggattcttacatttaatttggagggaaatgccatttttcccccttaaacaaggcatggggctcacaagtctatggagacaggccaaaaagaatgtggagaagaaaactgata

SEQ ID NO: 111 - DNA, 3517 bp, Homo sapiens
  CDS (196)..(654)
atagaaagccgctcgccagtagaaagccgtacgcacgcccgaccggaccggaattcccgggccacgattgcgtgtcctcggagcaggcggagtgaagggacttgagcgagccagttgccggattattctatttcccctccctctctcccgccccgtatctcttttcacccttctcccaccctcgctcgcgtagccatggcggagccgtcggaggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggctttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcagggctgagctttccactggcccataaagcagaaggagggggcccaaagtcagttgggcgtttctgctggcgtggagagcgctaccaggtgcccccggattttgatcgggagtcgcttttgcctttccgtggacaagccttcctccgccagcagatgccccgggcaggaagagaagcggtggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaaggatgcacgtgtgctagcgctgagcaggcaagagtcccacactgaagtatcagagaagctccagggcaaaaagcaagaggcaccagacccagatgatcactatgttggcatcgcccgagatcagaccaagtcaattgttgaaaagtaa

SEQ ID NO: 112 - DNA, 7057 bp, Homo sapiens
  CDS (1700)..(6637)
catcggatacccggctcacgacttcgtcctctcccccctttcctcacgctggtggtgttcctttcctcagtcctgctgatgtcctccagctgattccaggctgttcccggccacccctgaggccgtcctttcgcttcttgtaaaagcctccccgcctcctgagctccctcggtcgcctcccgagaagccaacgggcctctctggtggagcgctaggttgacagcgttttagcaggaccgcgagaaaccggggagatcctcttacgaggaaaaactccaagattacatccctgttatctttcctccaagtagtttctgatcataagttatttgtttaaaaatgatgttttaattagaatttatttgatggcttttaaaaaacttttactgacactcaacatgtttgtttttgtaggaactgactaaggctttggaacagaaaccagatgatgcacatatattatcgtcaaagagcttattgtcacattcttcttgggaattactgtggtgaaatgctcattgcagtgctgcaaaaaggtgaggtcacaggacacaaacccatatctgagacctggatgccttcctccacgcactcacccactggctgtcctgagcatcaccctgcacctattgtcacagcaacaagggaaaaatcagcagcacgctgcgtggctgctcgttggctacttacgacggaagctcggttggggtttctgcagaagtttcccccttgggcggtggcggagctgataagcgcgctagtagcagctctggcagaagcaacggtggcttcgagggatggcggcggctgcaacaggacctgcagcatcccagaggaactgactaagactttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggggaagtatgagaccctcgtgttttactggccctcgctgctgtgccttgccttcctgctgggccgcttcctgcatatgtttgtcaaggctctgagggtgcacctcggctgggagctccaggtggaagaaaaatctgtcctggaagtgcaccagggagagcacgtcaagcagctcctgaggataccccgccctcaagagaaaaaaaagtcttggttccaaaccaggatatatgagtgggatccctgctttcaatttccaagcagaatgattggaaccattgtgttggcattcatctgcctgtatcttttcattgtcatcgagttctgcgtgtttgtgtacgtgagagatgagttggatgtgcttgaaaacaacctggaaagctacatcaccttcacgaaccattcaggggtcctgaccccagtcatcctgcaggtgaaagagctgatcagtgtcaccaaaggagtctgggtggcgaccattttgcccgcgtatctcacgtgtgtgagctatctgttccacattttggtctgttacagaaagcacatgaagaggctatgggcaggagataaacattttcttcctttgaagttccataacccggcctcgtcggagagcatggtggccattgcaaggtactctggctggcaaatagcctatattctgtggggctacctcatcattcacatggtacagagcctatgtggcatggcaatcatgtacagcctggtgctacccatcgtccaaaccagggcctggaaatgctgcaagggctgggcattgggatgaaagcgttccacaacttcaactactttctgttcttctacaacgtgctgctgggcctgggtgcctgcctttccaggctgctcatcagttgcctcctcggcatgtggctgattgcccgcatcgacaggaccatcatgcagagtggctatgagggagcagacatggggttcagtgcatggattgggatgctctacatggaccattatcacatcaaccctgtgcttgtcagcttttgccacatcctgatcacaaatcacagggagaagaagctgcagcagagcaccaaatactggtgcctaaatcaatcggcagagtcccttcggatttgcgccatgcgcggcggggagaaccggcctcctgctcgagttcagagctcatctgaggaattggaattgagacaccaaagcctagacgcgtttcctggacgacggcttcccggcaggggcatccagccagcggccaagatgtcgtcagtggggaaggtgacccaggttccgaatgggaaagcctaccagcagatcttccaggctgaggtgcagctggtccactccctggcggccaccaggaagcgggctgcagagcgttctgtgaccctgaagagtggcaggatacccatgatgaagaaggtggagactcctgaaggggaggtgatgtctccccgacagcagaagtggatgcacagcctccccaacgactggatcatggaaaaccctgttctccacagggaaaaggaaagagccaagagggaaaaagcccgagagagtgagaacaccatcgctgcccgagaagtgcggggtctcatggatactatagttcctgagaagataagcaccagcacctttcaaaggcaagcagaacacaagaggaagagctacgagagcgctctggccagctttcaggaggagattgcgcaggtgggaaaggaaatggaacctctcatcgtggacacagggggactttttttgaagaagctgactgagtctgatgaagaaatgaaccgtctcttcctaaaggtggaaaatgacaccaaccttgaggactacaccatccaagccctgctggagctgtgggataaggtggccgggcggttactgctccggaagcaggagattaaggagctggatgaggccctgcactcgctggagttctcccgaaccgataaactaaaaagcgtgttgaagaaatatgcagaagtcatagagaaaacttcctacctcatgcggcccgaagtgtacaggctgataaatgaagaagccatggtcatgaactatgccctgctgggcaaccggaaggctctcgcccagctgtttgtcaacctgatggagtccaccctgcagcaggagctggacagccgccaccgctggcaaggcttggtggacacctggaaggctctcaagaaggaggccctgctgcagagtttcagtgagttcatggccagtgagagtatccatactcccccggctgtgacgaaggagctagaggtcatgctgaagacccagaacgtcctgcagcaaaggcggctgaagcatctctgcaccatctgtgacctcctgccccccagttacagcaaaactcagctgactgagtggcattcttccctcaactccctgaacaaggagctagacacctaccacgtggactgcatgatgtggatccgcctgctgtatgagaagacatggcaggagtgcctgatgcatgtgcagaattgtaagaagcagctgctggactggaaagccttcactgaggaggaggcagagaccctggtgaaccagttcttcttccagatggtgggagcactccagggcaaagtggaggaggacctggagctcttggacaaatccttcgagactctggcagatcagacagagtggcagagttcgcacctcttcaagtatttccaggaggtggtacaactgtgggaggcacaccagagcgagctgttggtgcaggagctggagctggagaagaggatggagcagcaccggcagaagcacagcctggagagccaggtgcaggaggcccacctcgataggctcttggaccaactgaggcagcaaagtgacaaagaaacactggcgtttcacctggaaaaggtcaaagattatctgaagaacatgaaatccaggtatgaatgttttcacaccctcctgacaaaggaagtgatggagtacccagcgatcatgctgaaagaactcaactcctacagctctgccctcagccaatacttctttgtgcgtgaaatctttgaacagaacttggctggagaagtcattttcaaattcaggcaaccagaagcacatgaaaaaccctcccagaagagagtgaaaaaactgaggaagaagcaagggtctaaagaggacatgaccagaagtgaggaaagcataagtagtgggacaagtactgccaggtcagtagaagaggtggaagaagaaaacgatcaagaaatggagtccttcataactgaagaggtgctggggcagcagaaaaaatctccactgcatgctaagatggatgagtccaaagaaggctctattcagggactggaagaaatgcaggttgaaagagagggctccttaaacccatccctgaatgaggagaatgtgaagggtcaaggagaaaagaaggaggagtcagaggaggaagatgagaaggaggaagaggaggaggaggagaagctggaggaagagaaggaggagaaggaggcacaggaagagcaagagagtttatctgtgggtgaggaagaagacaaggaagagggtctagaggagatatactatgaggacatggagtccttcacaatctccagtggaaacacttattttgtctttgtacccctggaagaagagcattgtaggaagtcccattccaccttctcagccatgttcatcaacgacacttccagtgccaagttcatagaacaagtgacaattccatcgagactaattttagaaattaagaaacaattgttttcagagggaggcaacttttctcctaaagaaatcaattcactgtgttcccgactggagaaggaagctgcccggatagagttggttgaaagtgtcatcatgctcaacatggagaagttggagaatgagtacctggaccaggccaatgatgtcatcaacaagtttgaaagcaaattccataacctgtctgtggaccttattttcatagagaaaatccagcggttgctgacgaatctgcaagtgaaaatcaagtgccaggtggcaaaatccaattcgcaaacaaatggattaaatttctctctgcaacagcttcagaacaagataaaaacttgtcaagagtccaggggagagaaaaccacagtgaccacagaagaactcctcagcttcgtccaaacttggaaggaaaaactgagccagaggattcagtaccttaactgcagcctggacagggtgtccatgactgaactggtctttaccaacaccatcctgaaggaccaggaggaagacagtgacatcctgacatcttcagaagcccttgaagaggaggccaagctggacgtggtcacccctgagtccttcacccagctgagccgcgtggggaagcccctgattgaggacccagctgtggatgtgatcaggaagctcctgcaacttcccaacacaaaatggccaacccaccattgtgacaaagatccgtcccagacaggcttcaagcgacatcggtgccagccagaaaactctgggaagaaggctgtacccagtgccagtgctacctctgcaggcagcctccagaccacccacccacctttgtcccacagcttcacaccgcaccccaagcccaacaaaatggagagaaagtaccgggtgcttggggacaagcctccccctgctgccgaggattttaaggggatcatcttgaccctcctctgggagagcagtgagaacctgctgacagtcgcagaggagttctaccgtaaagaaaaacgcccagtcaccaggcctgactgcatgtgtgacacctttgaccagtgcgccgagaacattagcaaaaagatcctggagtatcagagccaggcaaataagtaccacaactcctgcctcatagaattacggatccagatcaggagatttgaggagctgctgccccaagtgtgttggctggtgatggagaatttcaaggaacaccactggaaaaagtttttcacctctgtgaaggagatccgaggacagttcgaggaacagcagaagcggctggagaaaagaaaggacaaaaatgcccagaagctccatctaaatcttggacaccccgtacatttccaagaaatggagtctctacacttaagtgaagaggaaaggcaggaagagctggacagcatgattaggatgaacaaggagaagctggaggaatgtaccagaaggaatggccaggttttcataaccaacttggccaccttcaccgagaagttcctactgcagttggatgaggtggtcaccattgacgatgtccaggttgcaaggatggagccccccaaacagaaattatcaatgctcatacgaaggaaactcgctgggctctccctgaaggaagagagtgagaaacccctgattgaacgtggaagcaggaagtggccagggatcaaacccaccgaagtcaccatccaaaacaagattcttctccagccaacatcatcgatttccaccaccaaaaccaccctgggccacctggcggccgtggaagcccgagatgctgtgtacctgaaatatttagcatcatttgaggaggagctaaagaggatccaggatgactgtacatctcagataaaggaggctcagcgctggaaggacagctggaagcagtccctgcacactatccaaggcctgtatgtgtgaccctccgccccaccatgaataaacactttcttatacagactccttccctgtccatctacctgcctacctactttccgtccatccctccctcccttcatccctccacccctgctctgtgccgggcactgtagctttaccagcgaacaggacacagcatggtccctgcccacgtggagccctcttcccatgaggaaggcaagcatgaaaggggaattccacgtggttagcagggagggtgagtaccaggaatcagtcacttcaaataggcaccagagcttcaaaggacatcacctccaaacagcatgctgggcagggcacgtcatcttgaaaaatgaaataaaggtcatgggaaaatgatattttaatttaacagaataaacaagtatgggttataattgcaaaaaaaaaaaaaaaaaa

SEQ ID NO: 113 - DNA, 1170 bp, Homo sapiens
  CDS (755)..(898)
  misc_feature (1)...(1170): n = a,t,c or g
gaaacccaacccaaagaattatcaataaaaattttcaacctaaaagttcatctttggcaacttaaaacctaaaaattgaaacttgtccggtaaaacactggcccaacgcctgaaagcaaacccatccactgagggaaaacaccggccaagctggacagtaatgccccagaacagtagcagtaaataaaggtgaatcctgcaaagacgaggctgctcaccctccctctctctgctgtgtcaacacccacagagactctggaggagagaaaacatacctctctctcccaggcctttcccacacacactgaggttgagaagctgggaataaacagcgtccaacacttttaaatggcggtggcagctccagacaagggagaagggaaggactgagagaagaaattattagactttttagactggctgaacccagaacctttacattggttacaaaatcatgcctggaggtgaaaaattcaatagcattataccaagtgtttgggcaacggtgtagagacaatagtagagacaagctacagctttagacagtggtagagagaagctacaactttagcttgtagaaacagctgttgggtgttcagcagatgcagtctaggtgcatgcaaacccactgtgtgcagcatgccttcactctcacgacaagggagccagaccttgtgtctgcggctggctgaatattgcatggaatctgtggattcacagaggcttcttctcagctaagagggagtgtggctggatgcatttctctgtggctcattcaatttggggtatactcatactactgagtctctatgaaggagtgataagctgggtcttcaatttccaaatgtttaccaaactcctactatgtgccaagcactattcccactgctttgagagctaacggtaaacaacaacagtgaaaaaacatgtaacatcccaaccagtgcttctaaggatttaaaatatgctggtacttatgactntattcttacttctggattatagatatgtatatggctttggggatagnggtttgccacctttttggcccctttttccccccccccctttttttttttaaatgggccaaggccacccaactctggaaaatttattttggcgccaaaattttggaaaccccccccaaaaatttttttttctttacaaatt

SEQ ID NO: 114 - DNA, 993 bp, Homo sapiens
  CDS (76)..(282)
agtctttttttttttttttttttcctgattcttcatcattcaacttgagattattctaatcttgatttgattctcatgctcctttcaaaagagcatactagtttggggtggttggttattttcttaaccttagcaagccagcttatttcctatggaagcagaactggaaacagcagatgtccaccatgcttatacaggacactacacactgtctcgacaagccatgttctttcctccctcttcgtgagcactttctctggtgatgagttagtatggactacttgaacctcaaaactgggcctctcacccaaagccaaatgaagtagcgtatgccaggatgatgtttcttttgggccgttggcagtgagactgctaagcaggctgccttaggttttgctgtggcaatgctagcagattgttccctctttcaaaggggcaaaaatatcattttggtatgataactgactttctatttacagtttctggcccccaaagacaaaccaagtggagacacagcagctgtatttgaagaaggtggtgatgtggacgatttagtaagtacttttaatatgcacctggtgttctgtgattgaagtcacctgagctgtaaatacagccacaaaggctgattatcttacacttgttgcttatttgtgttttaatttccaatacaccagaagcttcctacaccattatatattgccattataaattcaatcagataggtaatttcataatagaaattcctgtgtttcatggtgtcggctatattgttcattcagattaatcctctcccttgaagggctgaaaaagagctagggaggctattccattagtagcaaaatgttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagacctgatagagcc

SEQ ID NO: 115 - DNA, 3748 bp, Homo sapiens
  CDS (270)..(2726)
actcgctctctgttcatgcctccattatgcactgtcgccgtttcctcctgaaccgtccgcgcactcgcatcatctagtcgctcatcaatagccacccaggctacctttaagctccggctcgcagtcgtgcgcatcggagccaccacacttcacctcggaacactatccatcatgacgcattaatccattcccataaggaacttggccccccaggcacagattccgcacgaggagacagctgagcttgagcacttgagaacctggatgatatgctcgcacccgccgcagagccaccgctgcggcgagacatcgcagacgcagactccagagccgccaccgtcctacagaggcccaccagtcggaggatcacacccaccgagattagctcattgtttgaacgccagggcctcccaggcccagagaagctgccgggctccttgcggaaggggattccacggaccaagtctgtaggggaggacgagaagctggcgtccctgctggaagggcgcttcccgcggagcacctcgatgcaagacccggtgcgcgagggtcgcggcatcccgcccccgccgcagaccgcgccgcctcccccgcccgcgccctactacttcgactcggggccgcccccggccttctcgccgccgcccccgccgggccgcgcctacgacacggtgcgctccagcttcaagcccggcctggaggcgcgcctgggcgcgggcgctgccggcctgtacgagccgggcgcggccctcggcccgctgccgtatcccgagcggcagaagcgcgcgcgctccatgatcatcctgcaggactcggcgcccgagtcgggcgacgcccctcgacccccgcccgcggccaccccgcccgagcgacccaagcgccggccgcggccgcccggccccgacagcccctacgccaacctgggcgccttcagcgccagcctcttcgctccgtccaagccgcagcgccgcaagagccccctggtgaagcagctgcaggtggaggacgcgcaggagcgcgcggccctggccgtgggcagccccggtcccggcggcggcagcttcgcccgcgagccctccccgacccaccgcggtccgcgcccgggtggcctcgactacggcgcgggcgatggcccggggctcgcgttcggcggcccgggcccggccaaggaccggcggctggaggagcggcgccgctccactgtgttcctgtccgtgggggccatcgagggcagcgcccccggcgcggatctgccatccctacagccctcccgctccatcgacgagcgcctcctggggaccggccccaccgccggccgcgacctgctgctgccctccccggtgtctgccctgaagccgttggtcagcggcccgagcctggggccctcgggttccaccttcatccacccactcaccggcaaacccctggaccccagctcacccctggcccttgccctggctgcccgagagcgagctctggcctcccaggcgccctcccggtcccccacacccgtgcacagtcccgacgccgaccgccccggacccctgtttgtggatgtacaggcccgggacccagagcgagggtccctggcttccccggctttctccccacggagcccagcctggattcctgtgcctgctcgcagggaggcagagaaggtcccccgggaggagcggaagtcacccgaggacaagaagtccatgatcctcagcgtcctggacacatccctgcagcggccagctggcctcatcgttgtgcacgccaccagcaacgggcaggagcccagcaggctggggggggccgaagaggagcgcccgggcaccccggagttggccccggcccccatgcagtcagcggctgtggcagagcccctgcccagcccccgggcccagccccctggtggcaccccggcagacgccgggccaggccagggcagctcagaggaagagccagagctggtgtttgctgtgaacctgccacctgcccagctgtcgtccagcgatgaggagaccagggaggagctggcccgaattgggttggtgccaccccctgaagagtttgccaacggggtcctgctggccaccccactcgctggcccgggcccctcgcccaccacggtgcccagcccggcctcagggaagcccagcagtgagccaccccctgcccctgagtctgcagccgactctggggtggaggaggctgacacacgcagctccagcgacccccacctggagaccacaagcaccatctccacggtgtccagcatgtccaccttgagctcggagagcggggaactcactgacacccacacctccttcgctgacggacacacttttctactcgagaagccaccagtgcctcccaagcccaagctcaagtccccgctggggaaggggccggtgaccttcagggacccgctgctgaagcagtcctcggacagcgagctcatggcccagcagcaccacgccgcctctgccgggctggcctctgccgccgggcctgcccgccctcgctacctcttccagagaaggtccaagctatggggggaccccgtggagagccgggggctccctgggcctgaagacgacaaaccaactgtgatcagtgagctcagctcccgcctgcagcagctgaacaaggacacgcgttccctgggggaggaaccagttggtggcctgggcagcctgctggaccctgccaagaagtcgcccatcgcagcagctcggtgagcagggcggtgcggggagggatccgtgccttgtccgtggccccgtctgtcattcctcttgtctgttctctggctctcctgttcctccttgttctgttccattccttctgtggcaacccccaacccgcccccgccatccacctctgaatctggtcttgcttggcctgcccgagagaggaggttcttctgggcgtctgacacgtcagggttgctgctcactgtgtccctgttggtgccagaagtgggagctgggctcccctcagagactcaggttgggcatgaggcgcctccatggccctcctggaggctcttggccccagggattcctgtgagttctctctctccctcccgacacaggctgtctttaccattaagggttgttttgtgttttactttggaggtacgcctccctcctcccatcctctctgtggccatgtggctgcccagtgtggctgataccctctgccttacagctgcctcctgccttgcttcctctggcggcttggagcacactgactccttttcttttgggggatctgccactaactccctatttcccatcccagaaacatttgtctcttggcaccaccttaaaatcccttaaacatggattcccgtgggtcatttctaaagtgcagtaagaagatagatggaagtcacgccatctccctgcactccatctgccctcttgccttctccccaccacttccccgtctgtcctgcccctgcccagaaggatctgagcaggggcctggcttgctgctgaggctgtcacagctgccagagccctgggctgatcccataggtctttccttgaggacccgactcccaaggctccttccaaagaggagcccttcgggcccgtgggctgcatggatgctggcggcagagctggtcatcccccacccgcccccttgtctgcctttttaaagctgcttttgccttctgtgcccctaggtctcccctctcctctttgggtctgggggggtggtatgtggatgccacctcttgactcctgct

SEQ ID NO: 116 - DNA, 1615 bp, Homo sapiens
  CDS (122)..(667)
acctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccgtcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagc

SEQ ID NO: 117 - DNA, 1765 bp, Homo sapiens
  CDS (122)..(817)
acctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtttgaacggtgtccccgggagcatctgggactttgtttccggcagcttctcccccagcccctcccccgtcctgagtgccggccccccatcctcttcgagtgcaagtccaaacggagctgagctggcccgggtcaggcggcagctggacgaggccaagaggaagatccggcagtgggaggagtcctggcagcaggtgaagcaggtctgcgatgcctggcagcgagaggcgcaggaggccaaggagcgtgcccgtgtggccgatagcgaccggcagctggcgctgcagaagaaggaggaggtggaggcacaggtgaagcagctgcaggaggagctggagggcctgggcgtagcctccacactgccggggctgcggggctgtggggacatcggcaccattcccctgccgaagctgcactcgctgcagagtcagctgcgcctggacctggaggcggtggacggcgtgatcttccagctccgcgccaagcagtgtgtggcctgccgggagcgggcccacggtgctgtcctgcggccctgtcagcaccacatcctctgtgagccgtgtgcggccaccgcacctgagtgcccctactgcaagggccagcccctgcagtggtgacctcagcggggacagccacctcctgctgggcaccctggctccagcgctcctcctgaccacggacatgtcgtcactcgcttctggtgccaccgacgtgaggaccgaggctgggagcccttcctgttacacgttatcatgaggctgggagccccgcctgcgcttggcctgacagcctttcctgtcacacgttgtcacctatctagtcctaccgacggtttcaaggtattttcctcaaaaaccttaaatgcaaacccacagaacccgcctgcctgtccctgaggggcctggtgcctccgggatccacgcggcgctgtgatcacagcagtttgtggtcctgacactactgtgactaggccactgggagctggggtctttcaaagcactttgtaaaccgaggaatttagttagaggttataaattgctctaagctgctttctgtttttttttaatatgcgataatatgaagctttatatgtgtactgtgaacttaaatatttcatatcagtttattgtcaattcatagtatgctaaatatattagatttcatattctgaaactagtacttatgaaatgagtgtttatctagtagtaagacctaggatttttacattttccaattaagtgcaaatagtatttataagcagagtgattatggattgagatgtttttaacttgatggaaggagctagttttcctgagcctgtgtgtgcaccaggcactggggctgatgttccagcctcgtggcgtgggagcaggagagctccgtcctgcatttctgtggtccgtggccgctgtttctgtgcgcctgcgcctcggagagcaagtgaaggagcatcatgggttttgttttctcccttaaccctctgaaagacagtttgatactaacaaaaaacgcagcagaggggatccaacgtcagagcttttagaattacttttttaagcagc

SEQ ID NO: 118 - DNA, 4473 bp, Homo sapiens
  CDS (67)..(1509)
gcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctacgacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgttccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccaaggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccacctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggaggtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaaaaaaaaaaaaa

SEQ ID NO: 119 - DNA, 866 bp, Homo sapiens
  CDS (15)..(734)
gcgcggcggacgggatgaggcgctgcagtctctgcgctttcgacgccgcccgggggcccaggcggctgatgcgtgtgggcctcgcgctgatcttggtgggccacgtgaacctgctgctgggggccgtgctgcatggcaccgtcctgcggcacgtggccaatccccgcggcgctgtcacgccggagtacaccgtagccaatgtcatctctgtcggctcggggctgctgagcgtttccgtgggacttgtggccctcctggcgtccaggaaccttcttcgccctccactgcactgggtcctgctggcactagctctggtgaacctgctcttgtccgttgcctgctccctgggcctccttcttgctgtgtcactcactgtggccaacggtggccgccgccttattgctgactgccacccaggactgctggatcctctggtaccactggatgaggggccgggacatactgactgcccctttgaccccacaagaatctatgatacagccttggctctctggatcccttctttgctcatgtctgcaggggaggctgctctatctggttactgctgtgtggctgcactcactctacgtggagttgggccctgcaggaaggacggacttcaggggcagctagaggaaatgacagagcttgaatctcctaaatgtaaaaggcaggaaaatgagcagctactggatcaaaatcaagaaatccgggcatcacagagaagttgggtttaggacagcaggtgctgttccgagactcagtcctaaagggttttttttcccactaagcaaggggccctgacctcgggatgagataacaaattgtaataaagtaacttctcttttcttctaaaaaaaaaaaaa

SEQ ID NO: 120 - DNA, 2586 bp, Homo sapiens
  CDS (174)..(2546)
ttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggacttggtggctttcgaggatgtggctgtgaacttcacccaggaggagtggtctttgctggatccttcccagaagaatctctacagagaagtgatgcaggaaaccttgaggaatctggcctccataggagaaaaatggaaagaccagaacattgaagatcagtacaaaaatcccaggaataatctaagaagtcttctgggagagagagttgatgaaaatacagaagaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatatgaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaaacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggactcacactggaaagcaactgtatgaatctaaacaatgtgaaaaaacctttggatctgtcagaaaccttcaaattcatgaaaagacacaccctggagagaaaccctataaggaacatggaaaagcattcaacaatttctcttcctttcaaatacatgcaacaatgcacagaggacagaatgcctatgaatgtaaagagtgtgacaaagcattcatatctgccaagatccttcgagtacatgcaagaacacaccctggagagaaaccctatgaatgtaaggaatgcggaaaagcacataaaagggctcacactggagtgaaaccgtatgaatgcaaggaatgtggcaaagccttcacttcttctggttcctttcagtgtcataaaaggattcacactggagagaaaccctatgagtgtaagcagtgtggtaaagccttcatttcttccactgccattcgtagacatgaaaggactcacactggagagaaaccctatgagtgtaagcaatgtggaaaagcctttatttctttcagttccattcagtaccatgaaaggactcacactggagagaaacagtatgagtgtaagcagtgtggtaaagccttcatgtcttctactgcatttcagtatcatgaaaagacccacaccagagagaaacactatgaatgtaagcagtgtgggaaagccttcatttcttccggtagccttcgatatcatgaaaggactcacactggagagaaaccctatgaatgtaagcagtgtggtaaagccttcagatctgccactcaacttcagatgcatagaaagattcacactggcgagaaaccctatgaatgtaagcaatgtgggaaagcctacagatctgtctcacaacttctggtgcatgaaaggactcacactgtagagcaaccctatgaatataagcaatatgggaaagccttcagatttgctaagaaccttcaaatacagacaatgaatgtaaacaattaaatgtttatagcagctgcatactaaaaaaaaaaaaaaa

SEQ ID NO: 121 - DNA, 1289 bp, Homo sapiens
  CDS (499)..(1050)
ctgtcctgatatagatggagaggggactggtttaaaatgacagtctcaagttcatttagaaagagaaggctaattcaaagaaacagcaaggcaagcttcctttctctgtaggaatcattattatccccctttgtcatggcccaccggggagcccattttgcctttagatcccgctggcagaagaccgacgatgaactctgtagacatagcatgtcttttatccttcacaaagccattcgcaatgacttctttcagagctatctctacctgctggaaaaaattcccctgggtccagattaagattttgaatctgatacatatctgtcattttgggatttcttttcattggattcctggttaattacgtcatctttcatcgtgcatcttctcttgattgtaaccctcattgggctggaatatagcttcaagaaacttctgaagaatgaatctataggagtgaaattgtacgctttaacaagccaagtcatcaatggtgagatgcagttctatgccagagctaaacttttctaccaagaagtaccagccacagaagagggtatgatgggaaatttcattgaactgtccagcccagacatccaggcctctcagaaatttcttaggaaatttgttggggggcctgggagagctggaacagactgcgccttggactgcggctccgggataggaagggtcagcaaacacgtcttattgcctgttttcaacagtgtggagctggtggatatgatggaatcctttctccttgaagcccagaactacctgcaggtcaaaggtgacaaagtagaaagctaccactgctacagcctgcaggaattcacaccccccttcaggagatatgatgtcatctggattcagtgggtcgtagggcacctgactgataaggaccttcttgcatttctttcccggtgccgagatggcctgaaagaaaatggcatcatcatattgaaggacaatgtggcccgggagggctgtatccttgatctctctgacagcagtgtgactcgggacatggacatcctccggagccagagctaaatcaaatggtaaaccattaccaaacagtctaagtgcagcaaaacaatggtacttatgttttaggcctttgtaattcttagagcaaattagcagaatcttctttttaggctcatcctgggaattttctgtttctttcaccagtatccttaattctcttaacccttgactttctgctttgccaatattcacaagctgattgacacagttgtcaatattctctgctatgggcttctgag

SEQ ID NO: 122 - DNA, 1534 bp, Homo sapiens
  CDS (71)..(1441)
ctgggtccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgagtgggtggatggccttctacccctcagaaccaacctggcccccaggacgtagccccaccaagcctctctctctggacccccatctcagggcctgcccttggctaaagtcaataaagtctattctaagagcaaaaaaaaaaaa

SEQ ID NO: 123 - DNA, 538 bp, Homo sapiens
  CDS (72)..(422)
ccgtcgacgtgaaatagcctcagactttagtgtcagtcaatcccggagatgtcctaaccctggcctgcaatatgtctgctctgtccccagaagggcctgtcttgtggttcaagagcattgggccaggacaacaattaatctttagttgcaatggaagccacttccccagagtaactccagtggaaaacacaatggttgatcaaactgactattccattcgcatcagtgacgtgttgccagaggatgctggcacctactactgtgtgaagttaagggtaggacaccctgacatggagtttttctctggtccaggcaccaccgtgtatgtgaatggtgagcacagcctgatgcactttattccctgggtttatgaagatgaatctttaaaacccttcaccatgtaccaaatcatcactatatactgaacaccatgctcctttatccacgaactaccctgtagactaggtttcttctaatagcctttctagtaagccattctggacaacctgtgccaaatactgaatcaagctatgttgac

SEQ ID NO: 124 - DNA, 1978 bp, Homo sapiens
  CDS (95)..(1894)
tttcgtgcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaagaaattacatcaggagagaatgatattatcaacccacagaaatgcctttaagaaaataatggagaagcaaaacatagagtatgaggcactaaaaacacaattgcaagaaaatgagacacattctcagcttacaaatttggagagaaagtggcaacaccttgagcaaaataattttgcgatgaaagaattcatagcaaccaagagtcaagagagtgattaccagccaattaagaaaaatgtgaccaagcagattgcagagtacaataaaaccatcgtggatgctttacatagcaccagcggaaactgagtttaagtccactgaaagtctctaaggaagtatcctcttgctgctaaacttggtacaagttgactaccaaaaaaaaaaaaa

SEQ ID NO: 125 - DNA, 3948 bp, Homo sapiens
  CDS (60)..(1844)
tgccacaactgattctaaaggatccgaagcagctcaacagtagcttcaaaagaactggaatggaatctcaacctttcctgaatatgaaatttgaaacggattatttcgtaaaggttgtcccttttccttccattaaaaacgaaagcaattaccaccctttcttctttagaacccgagcctgtgacctgttgttacagccggacaatctagcttgtaaacccttctggaagcctcggaacctgaacatcagccagcatggctcggacatgcaggtgtccttcgaccacgcaccgcacaacttcggcttccgtttcttctatcttcactacaagctcaagcacgaaggacctttcaagcgaaagacctgtaagcaggagcaaactacagagatgaccagctgcctccttcaaaatgtttctccaggggattatataattgagctggtggatgacactaacacaacaagaaaagtgatgcattatgccttaaagccagtgcactccccgtgggccgggcccatcagagccgtggccatcacagtgccactggtagtcatatcggcattcgcgacgctcttcactgtgatgtgccgcaagaagcaacaagaaaatatatattcacatttagatgaagagagctctgagtcttccacatacactgcagcactcccaagagagaggctccggccgcggccgaaggtctttctctgctattccagtaaagatggccagaatcacatgaatgtcgtccagtgtttcgcctacttcctccaggacttctgtggctgtgaggtggctctggacctgtgggaagacttcagcctctgtagagaagggcagagagaatgggtcatccagaagatccacgagtcccagttcatcattgtggtttgttccaaaggtatgaagtactttgtggacaagaagaactacaaacacaaaggaggtggccgaggctcggggaaaggagagctcttcctggtggcggtgtcagccattgccgaaaagctccgccaggccaagcagagttcgtccgcggcgctcagcaagtttatcgccgtctactttgattattcctgcgagggagacgtccccggtatcctagacctgagtaccaagtacagactcatggacaatcttcctcagctctgttcccacctgcactcccgagaccacggcctccaggagccggggcagcacacgcgacagggcagcagaaggaactacttccggagcaagtcaggccggtccctatacgtcgccatttgcaacatgcaccagtttattgacgaggagcccgactggttcgaaaagcagttcgttcccttccatcctcctccactgcgctaccgggagccagtcttggagaaatttgattcgggcttggttttaaatgatgtcatgtgcaaaccagggcctgagagtgacttctgcctaaaggtagaggcggctgttcttggggcaaccggaccagccgactcccagcacgagagtcagcatgggggcctggaccaagacggggaggcccggcctgcccttgacggtagcgccgccctgcaacccctgctgcacacggtgaaagccggcagcccctcggacatgccgcgggactcaggcatctatgactcgtctgtgccctcatccgagctgtctctgccactgatggaaggactctcgacggaccagacagaaacgtcttccctgacggagagcgtgtcctcctcttcaggcctgggtgaggaggaacctcctgcccttccttccaagctcctctcttctgggtcatgcaaagcagatcttggttgccgcagctacactgatgaactccacgcggtcgccccttggtaacaaaacgaaagagtctaagcattgccactttagctgctgcctccctctgattccccagctcatctccctggttgcatggcccacttggagctgaggtctcatacaaggatatttggagtgaaatgctggccagtacttgttctcccttgccccaaccctttaccggatatcttgacaaactctccaattttctaaaatgatatggagctctgaaaggcatgtccataaggtctgacaacagcttgccaaatttggttagtccttggatcagagcctgttgtgggaggtagggaggaaatatgtaaagaaaaacaggaagatacctgcactaatcattcagacttcattgagctctgcaaactttgcctgtttgctattggctaccttgatttgaaatgctttgtgaaaaaaggcacttttaacatcatagccacagaaatcaagtgccagtctatctggaatccatgttgtattgcagataatgttctcatttatttttgatgtagaatttacattgccatgggtgttaaataagctttgagtcaaaagtcaagaaagtgactgaatatacagccaccttttatgaaatgaggctctgtgttactgggtggcatgactgattgaggtgaagctcacggggccaggctgaccgtcttgaccgttccacttgagataggttggtcatcgtgcagaaggccccaggacctcagcacacacagcctcctcttggtctgagtaggcatcatgtgggggccagatctgcctgctgtttccatgggttacatttactgtgctgtatctcagatgttggtgtctggaagtttattcttaagagactgctacccagctggtctgtattattggaagttgcagttcgtgctttggttggccttctggtctaaagctgtgtcctgaatattagggatcacaattcactgaaatacagcagtgtgtggaggtgatggccagttaatctgctgaactggttttgactaatgacaaacctctttttaagatggtagaatggaggtgatagtcacaaaagtaaatgttccatttttatgaatgactttctacagagtttctatttctaaagaaaaaacaattgttcacatcccatctgatgattagcatgtgtgtaatgaatgctgtcttggtctcccctgtggaaacccttctccctgtgccttagagcaggtgtgtacatctctcactacctttctcatgggtgctgttagattttggcacccgttttctcagcattcagcccagggaatgtggttttcacttcttcgtcaagaccaacatgaaggggtatgttgagaaacatcctgaggcaaggtgggaggtgggatggggcaggactttcccttccaagcacatgcatggcaggtggggaaaggggggcttgcacccctgctggaaagaaaaggtttgtgtatatttctgatgcaaatgtcatactcactgctctgtaaaggcagctggcagctttttgggaaaagaacgtgctcgtctgttctctggcatcaagtttcttgcagctgctctgagggagagacagtgagctgcaagactgcctccccataacaacaggcaactcagagaagagtcattttatgttgttcctatggaatctggaatgagtgcagagctcctacccacacatgactgccccgccatttcatcctaggcattctgtgaaggagattggttagtccaaacttgctaacatacgaaaattcacttggaacatgatgagagatttcttattgaggccaagagatgtttcctgtcccagaggaaccattaggagtcgcttttagggtattcagctttgttcatgaaataaggcatctctgagaaagtggccccagggagagaatggaggactgggaggagaagcattaactgagctccaagggtgtgtgggcagagagcttgctatgtgaactcactccttaagaaaatggaagagaaaaagagagtgctagttaaaaaatcgggatgttttagtttggatttagggttttgatacttatgttgaaatactaatgtttctgatcaataaaatcaaactcttaatataaaaaaaaaaaaa

SEQ ID NO: 126 - DNA, 2680 bp, Homo sapiens
  CDS (2041)..(2499)
actttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaagacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttttcaccgctcccccatcagccatgaaggctccctgtcctcagctgccatgtcccccagcttctcaccctctctgtctcctctggctgctcgctcacccgttgtctcaccatttgggggggcccagggtccctcagcctcagcactcagcgcaaagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccaaaaaaaaaaaa

SEQ ID NO: 127 - DNA, 1497 bp, Homo sapiens
  CDS (210)..(1190)
gcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggacgggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaaaaaaaaaaaa

SEQ ID NO: 128 - DNA, 673 bp, Homo sapiens
  CDS (219)..(485)
acaagtggggcatctgtaggggccacagtgagctctcaatgatcatctgtagtggcagcaaaagagttcgagccccacttcaaacaacttcataataaaaggccagacaaaagagctgtcagccagttactacagacactcaatgcagacaccttcagagtattgggaaaagacttgccttctgccagaacttaacccaaatacacacagagagcaccatgaagccctggattcttctactcgtcatgttcatctctggagttgtgatgcttctgcctgtgctgggaagcttctggaacaaagatccctttctagatatgataagagaaactgagcagtgctgggtacagcctccatataagtactgtgagaaaaggtgtactaaaataatgacttgtgtacgtccaaatcatacatgctgctggacctactgtggaaacatctgcttagacaacgaagagccccttaaatcaatgctaaacccctagattctattggccgatcactactgtgggctgaaggatgaccatctggtctaagaagagtgctgcctacttccttcttgggacacccactggctctagctggtaacctttctgctatttccttgacctctttaccctgaagcttttgtcaaataaactgctacatcaacctgaaaaaaaaaaaaaaa

SEQ ID NO: 129 - DNA, 1470 bp, Homo sapiens
  CDS (55)..(714)
gtcgggcttgaagccatagctgcgggaccgtactcgtctcccccgacgcagaccatggagagcgcgctggcggtgccccggctgcccccgcatgatccagggacgccggtgctgtcggtggtggacatgcacacgggcggcgagcccttgcgtatcgtgctggcggggtgtccggaggtgtctgggcccaccctgctggccaagcggcgctacatgcgccagcaccttgaccacgtgcggcgacggctcatgttcgagccccgagggcaccgggacatgtacggggcggtcctagtcccgagcgagctgccggacgcgcatctgggcgtcctgttcctgcacaacgagggctacagctccatgtgcggccacgcagtgctggcgctgggccgcttcgctttggacttcgggcttgtgccggcgccccctgcgggcacccgcgaggcccgcgtcaatatccactgcccctgcgggctggtgaccgccttcgtggcatgcgaggacggccgcagccacggaccggtgcgcttccacagcgtcccggccttcgtgctggccacagatctcatggtggatgttcctggacatggaaaggtgatggtggacattgcatatggcggtgcattttatgcatttgttactgctgaaaagttaggactagacatttgttctgcaaagaccagggaccttgtggatgcagcgagtgcagtgacataggcagtgaaagctcagtttaaaattaatcatcctgatagtgaataccttgcctttttatatggaactatattaacagatggaaaagatgcttataccaaggaaccaaccaccaacatttgtgtttttgcagatgaacaggttgacagaagtcccactggctcaggagtgacagcccgaattgccttacagtatcacaaagggcttctggaactgaaccagatgagagccttcaaaagcagtgcaactggctcagtattcacagggaaagctgtgagggaagcgaaatgtggtgattttaaagctgttatagtggaagtatcaggacaagcccattacacgggtacagcaagctttataatagaagatgacgacccattgagggatggatttcttctcaagtgacttcttccatgattttaagggctttctttttaaagtaatcattatccttaaggactgttttctctaaattatatgaaaacaaataaattatacatataaactaactctcattctttgtaaaatactaccctgtggctaaatataaagtcattatacctcgtatttgcaactgtatttgtataaatatcacttatgtctagcatacaaaatgccagaaattcagagtctttttctagtgattaacgtatcaggtaaaattaaaacagtagttacttttaaaatattgctctatagtaattactattaatatcatattttgtattaaaggctcttcgaataataaaaaaaaaa

SEQ ID NO: 130 - DNA, 1583 bp, Homo sapiens
  CDS (375)..(1580)
tttccggtcttgctgaggcgctcctttccccgccccacctccgccctcttttcagggaatttcgaaggggcgtggcgtctggcaagcgcgtccccaggggtgtgtatacgcgcgttcacgggaggttaaagagggaggagcctaacccttggtggcgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggccccgcggcgcggttggcggcggcgccccaggcgcgccccctcctccgatggcggcggagatccagcccaagcctctgacccgcaagccgatcctgctgcagcggatggaggggtcccaggaggtggtgaatatggccgtgatcgtgcccaaagaggagggcgtcatcagcgtctccgaggacaggacagttcgtgtttggttaaagagagacagtggacagtattggccaagcgtataccatgcaatgccttctccatgttcatgcatgtcttttaacccggaaacaagaagactgtccataggtctagacaatggtacaatctcagagtttatattgtcagaagattataacaagatgactcctgtgaaaaactatcaagcgcatcagagcagagtgacgatgatcctgtttgtcctggagctggagtgggtgctgagcacaggacaggacaagcaatttgcctggcactgctctgagagtgggcagcgcctgggaggttatcggaccagtgctgtggcctcaggcctgcaatttgatgttgaaacccggcatgtgtttatcggtgaccactcaggccaagtaacaatcctcaaactggagcaagaaaactgcaccctggtcacaacattcagaggacacacaggtggggtgaccgctctctgttgggacccagtccagcgggtgttgttctcaggcagttcagatcactctgtcatcatgtgggacatcggtgggagaaaaggaacagccatcgagctccaaggacacaacgacagagtccaggccctctcctatgcacagcacacgcgacaattgatctcctgtggcggtgatggtgggattgtcgtctggaacatggacgtggagaggcaggagacccctgaatggttggacagtgattcctgccaaaagtgtgatcagcctttcttctggaacttcaagcaaatgtgggacagtaagaaaattggtctaagacagcaccactgccgcaagtgtgggaaggccgtctgtggcaagtgcagctccaagcgctcctccatccccctgatgggcttcgagtttgaagtgagggtctgtgacagctgccacgaggccatcacagatgaagagttaaggcgagaatttaatctgagccttgcactcagcgccgcaaccatcactcaggttgctctagtttctgctggtttagaatatagtccacggcaagcagtaaaagctctcctttgccaccaagagatttgtggtatcctgtga

SEQ ID NO: 131 - DNA, 3976 bp, Homo sapiens
  CDS (456)..(2741)
cgtgcgagcggggccgcgggcgcgcaccgactcaagagccgactgtcagcctcgtgcgggccgtgagttctcctggcgctggtgacaggggcgctgggacaggggcgctgggggcgagccctggcgggggccaggtccgaggaccctgggcgcggcggccccgccaggaggtccggccgcgagcgtgacctcacggggaggggccagcgcggctggactgggcgctgagccgagcgccgggagagcagcgcaaagccgagccgcgaggagacgcactccgtggccccgatggagcggacaaagccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacaccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttagaaaacaagcttcatctaaagactctcatgtcaatgtggaccttggtgacaatcctgctttgttaaagcaaaaactatgcgaaagggtgagtctgtttagaagaaaaagcaaagactgaggtactgtgaatggagagcttcagctaagaggaggctctgtcccttttcagagccaaaggaaataatacaacaaaaaggaggcttctttggagacctaagtctattggatgtaaacaagacgttgtatttagggatgttctgtgtttctttcttttttgaagttgtcatcaattgctttactaagatttttaaatagtgaaaacctcctgtttagactttggtggaagatgaatcaaggaagcagggccctgtcttatgggtcacatgtctttggtgagtgagaagacctaaactcctggccatcatctcttatccaatacttagcagttggggattaaaccatccttgccttcagttctctccaatattaccaggcccaactcagtcttcagtgattttaaacagcattgacatcatctgtaaaaccatcatctgtaaaaccatctatgacatgagttttgagaaacaataatggggaaaatatttgggaccaagctgaagcactaatcccactaagttaaagacttctttccagtccaaggcaggcctgaatcaactgtctttaaataaaattttaagtgatgctgtattatatataggaaaaaatgcttaaaatcctgtcatttagaacagtgaaaagtatcttttgagattaaagtgactctttactgtaggaaaaatattaccccgggtttacagattcattgccgtggtcaggccatttttaagggaagagttatttaatataaataggccccgattttaagttccggttaaagttcattctccttccaagaacaaagtggtgatttttggttagggtgatcgccctcttaaaattggcagtgctgttccttgtgctgcccctgtcttttcccccgatggcattttttttttttttttttttttaacacaggttgaaacatttcatctattatctctgcctcatttctggagggttgtgtatcagttctctaacacttgttcctgagaactaaatgtcttttttattcttatttcctctctcataaacatttggtgaccttttaccaagtggtgagttaggttttttaaaataaaatgttcattgtatttgaaaaaaaaaaaaaaaaa

SEQ ID NO: 132 - DNA, 767 bp, Homo sapiens
  CDS (103)..(603)
gtctataggagaaaatggtgagatatcttctgtggtattaataaaagttaaaagcatttcaagtttaggcagaaaactaactgaaaaacgagaacctactgtatggctagtaatttcttccaagtcatacaagtattcgagaaatctgcaaccttgattagtaagactgaacacattggttttgtcatttattcatggaggaagcccaccacccacttggggagcaaaaggaaatttgccatctcaatttacttatcagaagtttctttgcaaaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggtgagatttaacatttagaggtgacagcatcccccacactggcagtgaattttttgtgctacaaacttggcaaaagtctgtgaaaagaagtttcaacttcatgtgttattaactatacaaatattagttgaatgaattgttgaattacatgaaaaaaaaaaaaaaaaaaaaaaaaaagg

SEQ ID NO: 133 - DNA, 868 bp, Homo sapiens
  CDS (349)..(708)
aaggatccttaattaaattaagcccttccccccggttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctgtccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcaggtgagccagatagatgggagtcttcataaatgatagcccagcaggacaatgaagaaatacttttcagtgcttaagaaagtgcctgtgtgcccttatttttaaatttttttaaaattctaaagcatttaaaatatatacagaagtccagaaaataaaataacattcatgtatccatcaaaaaaaaaa

SEQ ID NO: 134 - DNA, 967 bp, Homo sapiens
  CDS (103)..(909)
ggcctgcacagtgtctgtaaataccagagctggataagggatggcaatgagccaggaggcaatcacccagggaagtgcatggtgagcagcacaggctttgggatgaaaagagaactggacttctccggagcgaactacccgaaccccctttcggaatctctagcttcagcgcaccgcggtgccctgcttgccagccgtcagcctcaggcgcctgcccacaacaaacatggcgacaagggcgtctctggaaggccgggcagtgacgacagttctcgcgatagccgcgttttcctgcctatatctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccatcaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaa

SEQ ID NO: 135 - DNA, 445 bp, Homo sapiens
  CDS (217)..(312)
tcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagtaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacactttttttaaaaaaaaaaaa

SEQ ID NO: 136 - DNA, 3400 bp, Homo sapiens
  CDS (408)..(3176)
atttttctcgattgacattgataagcactgagagatcctcagtgaaggtaacccggcctgcagcagttcgcctattgatcctcggtattggcttggcaccttattgcccaaactggtaggatgattgctgaaatctgggaccttgttcctccagggatccctgatcttccaacgtttttcggtggggggtctgaggtttatttgctgttaaaaaactccttttttgggagttcccactcgcttcatcaaggaaggcaagcctgcctgcttctgcatcgacagatagccgtcttcagcttgagccccatcactaggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattagtaaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaaggaattcatgctggagagaaaccctacacttgtgaagaacgtggcaaagactttggatggtacacagacctgaatcaacacaagaaaattcatactggagagaaaccttacaaatgtgaagaatgtggcaaagcctttaataggtcaacaaaccttactgcacataagagaattcacaacagagagaaagcttacacaggtgaagatcgtgacagagcctttggatggtccacaaacctgaatgaatataagaaaattcatactggagataaaccctacaaatgtaaagaatgtgggaaagcctttatgcattcctcacacctgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacataggagaattcatactggagagaaaccctacacatgtggagaatgtggcaaaacctttagacagtccgcaaacctttacgtacataggagaattcatactggagagaaaccttacaaatgcgaagactgtggcaaagcctttggacggtacacagccctgaatcaacacaagaaaattcatactggagagaaaccttacaaatgtgaagagtgtggcaaagcctttaatagttcaacaaaccttactgcacataagagaattcacaccagagagaaaccctacacatgtgaagatcgtggcagagcctttggattgtccacaaacctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcaaagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagacctgagtcaacacacgaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaaggaatgtggcaaagtcattacgtcatcctcaagctttgctaaacataagaggattcatacaggtgagaaaccctttaaatgtttagaatgtggtaaagcgtttactagttccacaacccttactaaacataggagaattcatactggagagaaaccctacacatgtgaagaatgtggcaaagcctttagacagtcagcaatcctttatgtacataggagaattcatactggagagaaaccctacacatgtggagaatgtggcaaaacctttagacagtctgcaaatctttatgcgcataagaaaattcatactggagagaaaccctacacgtgtggagactgtggcaaaacctttagacagtctgcaaatctttatgcacataagaaaattcatactggagataaaaccatacaagtgtaaagaatgtggcaaagcctttaagtcatactacagcattcttaaacataagagaactcataccaggggaatgtcttacgaaggtgacgaatgtcgcggtctttaaatgctcctcaatcctttctaatcataagataattcataatgaagagaaactctaaaatgtgaaaaatgtgagaaggcttttaatcacacctcaatctgttgtagacataaaaagaatt

SEQ ID NO: 137 - DNA, 1349 bp, Homo sapiens
  CDS (161)..(1003)
aaggatccttaattaaattaatccccccccccccgctttttttcgccagccttacgggcccgaaccctcgtgtgaagggtgcagtacctaagccggagcggggtagaggcgggccgccacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttcacttcaggatcccttggttccagtaccccattatctatgacattcgggccagacctcgacgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtatccctgttgatccgccgggagctgacagagagggccaaggacttcagcctcatcctggatgatgtggccatcacagagctgagctttagccgagagtacacagctgctgtagaagccaaacaagtggcccagcaggaggcccagcgggcccaattcttggtagaaaaagcaaagcaggaacagcggcagaaaattgtgcaggccgagggtgaggccgaggctgccaagatgcttggagaagcactgagcaagaaccctggctacatcaaacttcgcaagattcgagcagcccagaatatctccaagacgatcgccacatcacagaatcgtatctatctcacagctgacaaccttgtgctgaacctacaggatgaaagtttcaccaggggaagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaaaaaaaaaaaa

SEQ ID NO: 138 - DNA, 694 bp, Homo sapiens
  CDS (234)..(425)
cctcctgttgtgaatgtatctcctgatctgtttaactcctgtgtgtgaaactttgtgattcatgcaatgagaacaaggctttacgtgaacagaccagagcccaggtgcagggcggtcattccagagcccaggtgcagcaggtgcagggcggtcattctgcccacacagtggttcagatccgttcagcagccagccgccggaaggccttctccacctgttcttcccacctgggcatggtgctcctgttctatggcaccggcagctccacctacatgcgacccaccacccgctactccccgctggaagggcgcttggctgctgtcttctactccatcctcatacccaccctgaatccgctcatctacagcctgaggaaccaggacatgaagagagccctgtggaagctctatctccaggtgccatactagggtctgccatctggatgcgggagggacccaaaaatccaccttcccaagattttccttgtggtcgtggtggaagtgttagtgcctccagagacccccaggaacacacctattcgccaaagttgtcaacaaagttgaattgcaatgaatcatgcaggagaaccctgatggatgtctggataaaatggagacaaatccaatgtgcatttaatttaagcaaatagtattaaatgtacacaggggaggagagaaagctcagaacaacgaca

SEQ ID NO: 139 - DNA, 836 bp, Homo sapiens
  CDS (135)..(587)
  misc_feature (1)...(836): n = a,t,c or g
gagtcncnaatcgagatccttagtccagtgcggaggaattcagattccagggtgtggaagtggctttgtggtgccacctctaaccgctcggaggtcaacccccattctacaccgaaaactaggccttggctgctatggaaggacagcggcaagaaagccacgcaaccctaacactcgcccaggctcatttcaacaatggagagtacgcggaggccgaggcactgtactccgcttacattcgccggtgcgcttgcgcggcctccagcgacgagagtcccgggagcaaatgcagccctgaggatttggctactgcatataacaacagggggcaaatcaagtacttcagggttgatttttatgaagccatggatgactacacatctgccatagaagtccaacccaattttgaagttccatattacaacagagggttgatactgtataggctgggatattttgatgatgctttggaagatttcaagaaggtcttagacttaaatcctggatttcaagatgctactttgagcttaaaacagactattctagacaaagaagaaaaacaaagaagaaatgttgcaaaaaattattgatatttttaacttaatggaagtattgattcatgatccttacatctgcatctagttatcagtaatttagatattgagctattttgatttatatttaagaaattaatacattagcactgaaagttaaatagtgtgtttaaggtagttaatttcaggttgaatgggttttttttaatgaagtgtaaataataccaatgtataagtgtatattattatattaaatattatagtaaaaaaaaaaaaaaaaaa

SEQ ID NO: 140 - DNA, 456 bp, Homo sapiens
  CDS (49)..(222)
gaattcccgggtcgacgatttcgtggacgttgtctgcaggcactcagaatggtccagcgtttgacataccgacgtaggctttcctacaatacagcctctaacaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagatgctgtaaaaaaaaaaaa

SEQ ID NO: 141 - DNA, 1341 bp, Homo sapiens
  CDS (947)..(1267)
aggatggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagtgaccttctcaggcattctgccctcctgggcccctctctccctgaaggggctttgtggcatctctggaagagcagggtgtgctgcactcatgggcctggtctcactccttggacttgtcaccttgtgacatttggcttaccagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcacacctggtcctggcttgtggagggacttgcactggaggtattgctctggcttgcctggggaagtgtcacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctcttcccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctcgtcttgacgggtgaagagaccaccgacatggtcgtagtccagcatatattgatggccctcttccggcgcggggcacgactccctc

SEQ ID NO: 142 - DNA, 4465 bp, Homo sapiens
  CDS (543)..(1796)
ggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcctctctacaaagcacaacactaatgttcgtttccttagacctcagttcaagtgcccctatttatttcaataagaacgcacatatcccagctgttttttgtttgtcacctctatttagttgttacctgtttctctcttctttcaccccctgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaactttttttttatggtttctaatatgtatgaccaatgtagccattgctttaaaatgtaccgtgtaaatataaacacatcctatcagaaaaaaaaaaaaaaaa

SEQ ID NO: 143 - DNA, 1760 bp, Homo sapiens
  CDS (458)..(937)
ggggggtagcagggggagagaaagagaacgaagggagacagagagactgagacagaaacaaagagggcggacgcagtgcagtaagagcagatgggcggacccaaatttcttcggcttcacgattttgcggaggtctagccctgcatccagccttgaaacagggtggggaggaggcagaaaggggagggactgcactccctctgagcgtgctagctccgactgcctgacggatcacccttccgctccaacatggctagttcctcaacgccgtgactcaagcctgttgtgccagcaggcgcactcagcagcgaccctcataggtggcgaaggtccgcgagagggttccgccaggctagacagtggagtgccgcacagcgcgccttccagcctcgcagccgccaccctagcggttccgacccggcgccacaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgctgtgctatgtgtgtgttatggatcatcactgcccttgggttaataactgcattggattttccaactacaaattcttccttcaattcttagcttactctgttctctactgcctgtacattgctacgacagtcttcagctatttcatcaaatactggagaggggaattacccagtgttcgctctaagttccatgtcctttttcttctctttgtggcctgcatgttttttgtcagccttgtgattctctttggttaccattgttggcttgtcagcagaaacaaaaccaccttagaggccttctgcactccagtgtttacaagtggcccagagaaaaatgggttcaaccttggcttcatcaagaatatccagcaggtgtttggagataagaagaagttctggttaatacctattggttccagccctggtgatggacactccttccctatgaggtctatgaatgagtcacagaacccactgctagcaaatgaagaaacctgggaagacaacgaggatgacaaccaaggccctagggctctacaatcagcaggttgcaaagccagccaggtttctgttcttcccttctgggtggcgaattcccccaggttccaggcagttccagagatgccatctgggagtcagcacttagatttagaaatcttaagtatcaacctggtgctctgttccaatgtggctgagcaggcaccaaagccagaagacaaagtccttttcactcttccctcccctttccacaaatacacagttatctcgctgtggccactactgccccaggcccacagcacctactgcctggctactggcaatgttcactcaaggcccaagggctcttcaataagggtatggtga

SEQ ID NO: 144 - DNA, 241 bp, Homo sapiens
  CDS (86)..(238)
ctactaaattcgcggccgcgtcgaccagttgtacagggatgccatcaggttcctcctgtgccttgtaggaacagccaccattgggatgatccatactctgtgtgtctatgtgcttagtggggaacctccagaggaggtggtgaggaaagcccttgacgtcatcacaattgcggttcctccagctctacctgctgctctgaccacaggcattatgcatgcccagaggaggctgaagaagtga

SEQ ID NO: 145 - DNA, 865 bp, Homo sapiens
  CDS (196)..(741)
ggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggagggaattgcaatcctgcatcagttcccattctcatcggcactgcaaagaatgacagtcattgtccaagagatgggaggtgaccgactggcattcatgaaaggtgcaccagagagggtggccagcttttgccgacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgatttgaaggaagagacaaaacctgtcttggaagagctcatttccaccccgaataaggactgtaatgatcacaggtgacaatcttcagactgcaataacagtggccagaaaatctggaatggtttctgaaagccagaaagtcattctcattgaggcaaatgaaccgcagttaaaacc

SEQ ID NO: 146 - DNA, 920 bp, Homo sapiens
  CDS (135)..(785)
tttcgtggatggagccctcctcctgatcctgtagtggtagtaagaatcaccagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagaattgagccagttaaaggaaatatcacctttccccctggcagagcaacaggaatttataacttgacagtactcgatggacaggttggctaatttacatacccaatgggaacaggattctgggttgcggacacaccctgtttaacttaatggatggggccgccgcccctcctataatagctgctggctggatcactcg

SEQ ID NO: 147 - DNA, 2214 bp, Homo sapiens
  CDS (139)..(2064)
gctgatgcagtttctgcaggactgtaaactggattcctggaacctttgatattcctggctgtgtatagtgcctgttggtggactgtactgatactcaactagagtgtgaagggactggattcctgcccctgagacacaatgcaagctgtagtgcccttgaacaagatgacagccatctcaccagaacctcaaactctggcctcgactgaacaaaatgaggtcccaagagtggttacttctggggaacaagaagctattttaagaggaaatgctgctgatgcagagtctttcagacagaggtttaggtggttttgttactcagaagtagctggacccaggaaagctctgagtcaactctgggagctctgcaatcagtggctgagaccagacattcacacgaaagaacagattttagagcttctggtgtttgagcagttcctgaccattttgcctggggagatcaggatttgggtaaagtcacaacatcctgagagtagtgaggaagtggtgaccctaatagaagatttgacccagatgcttgaagaaaaagatgaatcagctttagataaaataatagaaaggtgcctcagggatgatgatcatggcttgatggaagaatcccagcctatattgtggcagctcagagagaggatcacggtaatcagggaaatacaacaggaagagtcgcacaaaacaaaactcttgggagtggcagtaggggtaagaaatttagacccagataaaagccccttaggacataatttcaaagaaacttcagacttaattaaacatctgagagtctacttgaggaagaaatctcggaggtataatgaaagcaagaaacccttcagttttcattcagaccttgttctgaaccgcaaggagaaaaccgccggagaaaagtcacggaaatctaatgatggtgggaaagtcctgagtcactcttcagctcttactgaacatcagaaacgtcagaagattcatttgggggataggtcccaaagatgcagtaagtgtgggataatctttattagaagatcaactctttctaggcgaaaaacccctatgtgtgagagatgtcggaacgactcatatccagaagcagccttaaataacgatgcgggaaatgagagtggagaaaaaactcataaatgtagtaagtgtggaaaagcctttggctatagcgcctcactcaccaaacatcggagaattcacactggagaaaaaccctatatgtgtaatgaatgtggaaaagcttttagtgatagttcatcgctcacaccacatcatagaactcatagtggagagaaacccttcaaatgtgatgactgtgggaaaggtttcaccctaagtgctcacctcattaaacatcagagaattcatactggagaaaaaccttataaatgtaaagactgtgggagaccctttagtgacagttcatctcttattcaacatcagcgaattcatactggagaaaaaccctatacatgtagcaattgtggaaaatccttcagtcatagctcatccctttccaaacatcagagaattcatactggagagaaaccctataaatgtggcgaatgtggaaaagcctttaggcagaattcatgccttacccggcatcagagaattcacactggagaaaaaccatatttgtgtaatgattgcggaatgacttttagccattttacgtctgtgatttatcatcaaagacttcattcaggagaaaaaccctacaaatgtaaccagtgtgagaaagccttcccaacccattcactgctaagtcgtcatcagagaattcatactggtgtaaaaccttataaatgtaaagaatgtgggaagtccttcagtcagagttcatctcttaatgagcaccaccgaattcatacaggagagaaaccctatgagtgtaactattgtggtgcaacctttagtcgaagctcaatccttgtagaacacctaaaaattcataccggaaggagagaatatgaatgtaacgaatgtgagaagacatttaaaagtaattcaggcctcattagacatcggggatttcactctgcagagtaatcctggaactacattaaagtggggggaatttaattcaaattgtcaggtactgaaaccatgggatgtagaacataccggattgatcaggagctgcagctatcgtaaattggcagttgcgaacagaactctctagctcattcatacctc

SEQ ID NO: 148 - DNA, 618 bp, Homo sapiens
  CDS (66)..(344)
gcacgagcaacagcttgcggctgcggggagctcccgtgggcgctccgctggctgtgcaggcggccatggattccttgcggaaaatgctgatctcagtcgcaatgctgggcgcaggggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccagcgggaggtcaccgtgagaccggacttgcctccgtgggcgccggaccttggcttgggcgcaggaatccgaggcagcctttctccttcgtgggcccagcggagagtccggaccgagataccatgccaggactctccggggtcctgtgagctgccgtcgggtgagcacgtttcccccaaaccctggactgactgctttaaggtccgcaaggcgggccagggccgagacgcgagtcggatgtggtgaactgaaagaaccaataaaatcatgttcctccaaaaaaaaaaaaa

SEQ ID NO: 149 - DNA, 2274 bp, Homo sapiens
  CDS (155)..(1912)
agcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacagggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattaccattgctgtcacgcaacctagcaatacctacaaaaggaaagatgtgtgttggcttaactggtccaatggaagcaaaccactcctggcttttgttgtccctgcactggctattgtggctgtgaacttcgttgtggtgctgctagttctcacaaagctctggaggccgactgttggggaaagactgagtcgggatgacaaggccaccatcatccgcgtggggaagagcctcctcattctgacccctctgctagggctcacctggggctttggaataggaacaatagtggacagccagaatctggcttggcatgttatttttgctttactcaatgcattccagggatttttttatcttatgctttggaatactcttggacagtaagctgcgacaacttctgttcaacaagttgtctgccttaagttcttggaagcaaacagaaaagcaaaactcatcagatttatctgccaaacccaaattctcaaagcctttcaacccactgcaaaacaaaggccattatgcattttctcatactggagattcctccgacaacatcatgctaactcagtttgtctcaaatgaataaggcaaggaatcataaaatcaagaaaaaatttccagaacaacttgacatttagagacaaatgtcaatgaagaaattatgctcagtattcgatcgggttttctgatttaggggtctgggaataaaacaagaatgtctcagtggcttcaaaaaaaaaaaa

SEQ ID NO: 150 - DNA, 1445 bp, Homo sapiens
  CDS (656)..(814)
cagtcgcatccagccatgacagccttctgctccctgctcctgcaagcgcagagcctcctacccaggaccatggcagccccccaggacagcctcagaccaggggaggaagacgaaggtgcgccctcccactgggaatgggggaatagagcctacccagcttcttctaggaaggatgtgtgcccctccccagcacacagagtgagcgccaggaaaattctcacttcctctcttccttggctgcctttggtcacccctcctggtctgatctcagggtgattttttccatgatatgaacacacacatacacacaccatatgtgtgcacacagagagaatgaaacagctgccttcctaaggggctccgtcactgcccccgcttctcccttggggcagggagtatgactcctcctttccttctgcccagaagtgtgtgtagggaggggacactaagccagctccagacccttgtcccacccagcttccagtccatccacagacctcaccccccacttccatgtgctgtctgcaggggacatcctaagcctcacgacctgcacacgcctgggattttcaggctctctgatcaggtctgagggccagggagggttggctgggtgtttgctgagtgactcacagaaagtccgtctctctcagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcactgtggttgggtggaggtctgtctgcactgggagcctcaggagggctctgctccacccacttggctatgggagagccagcaggggttctggagaaaaaaactggtgggttagggccttggtccaggagccagttgagccagggcagccacatccaggcgtctccctaccctggctctgccatcagccttgaagggcctcgatgaagccttctctggaaccactccagcccagctccacctcagccttggccttcacgctgtggaagcagccaaggcacttcctcaccccctcagcgccacggacctctctggggagtggccggaaagctcccgggcctctggcctgcagggcagcccaagtcatgactcagaccaggtcccacactgagctgcccacactcgagagccagatatttttgtagtttttatgcctttggctattatgaaagaggttagtgtgttccctgcaataaacttgttcctgagaaaaaaaaaaaaaaaaa

SEQ ID NO: 151 - DNA, 497 bp, Homo sapiens
  CDS (52)..(363)
agtaggagcatctcagagcagagtgagctgcggtcatgattgaaggcagggatgctagcagcaaggaccccaaagaattatcagcattggggcccaaacttccccccaggctgggggaaactggacttcctgacatcaactaaccaggcgacatcctggataggcctcttcaaagatggccaaggaagtgcccacaggtggatggatggctcagcccccacctacataaactgggactccaggaaattggatgataatggaaccaccccagcctgtgtgatgatgctctaccagggacactggagcaactcctcttgcaaatcagagtctcctgtttacatctgtgagaagaggcagagctgctgacctaggcccctaccccataagattggtgtaaacctcttgttgtgcatcctcaacctccatccctgccctctttgggctttgaatccccagaggcaacaataaaggacgtttctccaaaaaaaaaaaaaaaa

SEQ ID NO: 152 - DNA, 3032 bp, Homo sapiens
  CDS (1)..(2814)
atggagaaccggcctgggtccttccagtacgtccctgtgcagctgcaagggggggcaccctggggcttcacccttaaggggggtctggaacactgtgagccgctcacagtgtctaagattgaagatggaggcaaggcagctttgtcccagaagatgaggactggtgatgagctggtgaatatcaatggcactccattatatggctcccgccaagaggccctcattctcatcaaaggctccttccggattctcaagctgattgtcaggaggaggaacgcccctgtcagtaggccgcactcatggcatgtggccaagctgctggagggatgccctgaagcagccaccaccatgcatttcccttctgaagccttcagcttgtcctggcattctggctgcaacacaagtgacgtgtgtgtgcagtggtgtccactctcccggcattgcagcaccgagaaaagcagctccattggcagcatggagagcctggagcaaccaggccaagccacctatgagagccatctgttgcctattgaccagaacatgtaccctaaccagcgtgactcagcctacagctccttctcggccagctcaaatgcttctgactgtgccctttccctcaggccagaggagccagcctctacagactgcatcatgcaaggcccagggccaactaaggcccccagtggccggcctaatgtggctgagacctcaggaggtagtcggcgcaccaatgggggccacctgacccccagctctcagatgtcatcccgtccacaggagggataccagtcagggcccgccaaagcagtcaggggcccaccacaacctccagtgaggcgggacagccttcaggcctccagagcccaactcctcaatggagagcagcgcagggcatctgagcctgtggtccccttgccacagaaggagaaactgagcttagagcctgtgctacccgcaaggaaccctaataggttctgttgcctcagtgggcatgaccaagtgacaagtgagggccatcagaactgtgagttcagtcagcctcctgaatccagccaacagggctctgagcatctactgatgcaggcctcaaccaaagctgttggatccccaaaagcctgtgacagagcttccagcgtggattccaacccactcaatgaggcttctgcagagctagctaaggcttcttttggcagacctccacatctcataggacccacagggcatcgccatagtgcccctgaacagctgctggcatcccacctgcagcatgtgcaccttgataccaggggcagcaaagggatggagctcccacccgtacaggatgggcaccagtggactctgtcccctttgcacagcagccacaaagggaagaaaagtccatgcccccctacaggaggaacccatgaccagtccagcaaagaaagaaagaccagacaagtggatgacaggtctttagttttgggacaccagagccaaagcagtcccccacatggagaggctgatggacacccctcagaaaaaggtttcctggacccaaacagaacaagcagagcagccagtgaattggccaaccagcaaccctctgcctctggctcccttgttcaacaagccacggactgttcttcaaccactaaagcagctagtggcacagaggcaggtgaagaaggggacagcgagcccaaggagtgcagccggatgggtggtaggcgaagtggagggacccggggccgctcgatccaaaaccggcggaagagtgagcgttttgctaccaatctgcgtaatgaaattcagaggaggaaggcccagctccagaaaagcaagggtcccttgtcacagctgtgtgacactaaggagccagtggaagagacccaggagcccccagaaagtcctccactcactgcctttaacacatctcttctatcttcatgtaaaaaacctcccagccccagagacaagctcttcaacaaaagcatgatgctcagagctaggtcttccgagtgcctcagccaagcccctgagagccatgaatctaggacaggcttagagggacgaataagccctggccagaggcctggccagtcctctttgggcctgaacacctggtggaaagcacctgacccatcctcctcagaccctgagaaagcacatgctcactgcggagtccgtggaggtcattggagatggtctccagagcataattcacagccacttgtggcagcagccatggaaggcccttccaacccaggtgacaacaaggaattgaaggcttctactgctcaagctggggaggatgccatcctcttgccttttgcagacagaagaaagttctttgaagagagtagcaaatccttatctacatctcatttgccaggtttaaccactcatagcaacaagacttttacccagagaccaaaacctatagaccaaaacttccagccaatgagctccagctgtagggaattgaggcgccatcccatggaccaatcatatcattccgcagaccaaccatatcatgccacagaccaatcatatcattccatgtcaccccttcagtcagaaactcccacttactcagaatgttttgcaagcaaaggtctagaaaattccatgtgttgtaagccactacactgtggtgattttgattaccacaggacctgctcttactcctgcagtgttcaaggagctctagtccatgatccttgcatttattgttctggggaaatctgccctgccttgctaaagagaaatatgatgccattgctacaactgccggtgccaccaccaccaatgcattcggtgttcagtttgctatcataatcctcagcacagtgccctcgaggacagcagcttggcacctggcaacacttggaaacccaggaagctgacagtgcaggaatttcctggggacaaatggaatccaataacaggaaacaggaagaccagccagtcagggagggaaatggctcattccaagactagcttttcatgggcaacccctttccatccttgccttgagaacccagcactggact

SEQ ID NO: 153 - DNA, 3017 bp, Homo sapiens
  CDS (306)..(2708)
gaattcccgggtcgacgatttcgtgccgcgagcaggggtgaagagacccagcggtgcaccagccgcccagtgggggaggcagctacgtgagcaggacgcccgccctggagcagttaggaccgaaggtctccggagagtcgccggcggtgccaggaagtcaacttcaagcagattgacttgaaacgggatctcatttaggaagcataagtgtccaatcaaaaactgtgtatttttttaaatttggaaaatactcaagttccagttgcttatcattctccttcactttctgaaaacctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtacctccgtcatccaagtgacagccacagatgcagatgacccgacctacggcaacagtgccagggtggtgtacagcattcttcagggccagccatatttttctgtggactctaaaacaggtgtaattaggacagcgctcatgaacatggacagagaagccaaagaatactacgaagtgattatccaagccaaggacatgggagggcagcttggaggattagctgggaccacaacagtcaacatcaccctctcagatgtcaatgataacccaccccgctttccccagaaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcagatactccattgatagaagcagtgaccctggaagatttttctatgttgacattacaacaggtgccctaatgacagcaagacccctagaccgggaagaattttcttggcataatatcactgtccttgctatggaaatgaacaatccctcccaggttggaagtgttcctgtcacaatcaaagtcttagatgtgaatgacaatgctccagagttccccagattctatgaagcttttgtctgtgagaacgccaaggcaggacagctgatccagacagtgagtgcggtggaccaagatgacccacgcaatggtcagcatttctactacagcttggctcctgaggctgctaacaaccccaactttaccataagggacaaccaagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggccccctcattgccatcctcgcctgcatctttgtcctcctagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccggccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccataaggaagagggcagaatctttaattaccttttttcttttctttttgatttttgtgacactgtgtgcgaaggcttggagtccaaggtgatctgacggggggggcgtatttatgccatg

SEQ ID NO: 154 - DNA, 233 bp, Homo sapiens
  CDS (34)..(174)
aagttttctggatgcacacactagtaaacacaaatgccaaagacttgccttccaattctctgtctacctctaactcaggctgttgtcttggcacagttaaacaacttttctagcctcaatattttcatcttcaaaatcaaaaataaaatgtattacatatggatctatgacaaatagtgatatattccatgtgcacgttattcattaaacatgaattaaccaatatttaaatc

SEQ ID NO: 155 - DNA, 965 bp, Homo sapiens
  CDS (128)..(925)
tttcgttgaactcatttgacttttctttatcagctgtaccatgtacatgatgtgcaagaggactggggctctgtgtcaaggccagctgggatgctgaggttttgtgttaggaccaagggcaagtctgatggctgttctggtttgccctgcttcatgccatggcctaaaggagtttaggataagaaggggaatgtggagattgtgcctggtttactatttttatccagcctcctcaactttgtatgtattgaggattgatgtcttaaactacacttccaaagatgaggggccttctgctgaagggccacagaggaacaccaggctgggatggattcagggcaagcaagtcactgtgctgggaagccctgtgcctgtgaacgtgttcctcggaggcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattaccccaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcacatactgtctcccatggccaaaggcttattccacaaagccatcatggagagtggggtggccatcatcccttacctggaggcccatgattatgagaagggtgaggacctgcaggcggttgcacatttctgtggtaacaatgcgtcagactctgaggccctgctgaggtgcctgaggacaaaaccctccaaggagctgctgac

SEQ ID NO: 156 - DNA, 4278 bp, Homo sapiens
  CDS (157)..(3744)
atgatggctgggaccagctgctggtatccttcatgtcctttaataggctccaggatgacgcctgagccaaaggccctacctcctgtggccttggttagagacaccgaaggccagctgtgtcttccccagcagagacaaagaggttggcaggttgtcatggcgaccagaaaggacacagaggaggagcaggtagtcccaagcgaggaggacgaagccaacgtgagggcggtgcaggcccactacctccgaagcccctcccctagccagtattcgatggtctcagatgcagaaacagaaagcattttcatggaacccattcacctctcctcagccattgcagccaaacagatcatcaatgaagaactcaagccaccgggggtcagagcagacgcagagtgtccaggcatgctggagtctgctgaacagctgctggtggaggacctgtacaaccgcgtcagggagaagatggatgacaccagcctctataatacgccctgtgtcctggacctacagcgggccctggttcaggatcgccaagaggcgccctggaatgaggtggatgaggtctggcccaatgtcttcatagctgagaagagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagaggacgtttgaccaacgtgggattgaatgggtctgtcggtcgcctgcggcgtaaggagtgtgtcccacctcgctcgcaggtcctggagcgcaccggcagacctcgaggcggagcggggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgacggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttggatttcacaagaaagacttgggagcgggagacagcagcggtgagcccggtgcagaggaggcagtaggggagaagaacccctccgacgtcagcctgacagcctaccaggcctggaagctgaaacaccagaagaaggtgggcagtgagaacaaggaggaggtggtggagctcagcaagggggaggactcggccttggctaagaagagacaacggaggctggagctgctggagagaagccggcagacgctggaggagagccagtctatggcaagctgggaggcggacagctccacggccagcgggagcattcccctgtctgcgttctggtctgcagacccctcagtcagcgctgatggggacacgacgtcagtactgagcacccagagccaccgctcccacctgtctcaggctgcaagcaacatagcggggtgttcaacctccaaccccaccacacccctgcctaacctgccagtggggcctggagacaccatttccattgccagtatccagaactggattgccaatgtagtcagtgagacccttgctcagaagcaaaatgaaatgctgctgttgtcccgctcaccgtctgttgcaagcatgaaggcagtaccagcggctagctgcctgggggatgaccaagtctccatgcttagtggacacagcagctcctccttgggtggctgcctgttgcctcagagccaggcaagacccagctctgacatgcagtctgtgctgtcctgcaacaccacactgagctcacccgcggaaagttgcagaagcaaagtgagggggaccagcaagcccatcttcagcctctttgctgacaatgtggacctaaaggaacttggccggaaggagaaggagatgcagatggagcttagggagaagatgtctgagtacaaaatggaaaagctggcctcagacaacaaacgcagctccctcttcaagaagaagaaggtcaaggaagatgaggatgatggtgtgggtgatggggatgaggacactgacagtgccatagggagcttccgatattcttcccgcagtaattcccagaaacctgaaacagacacatgctcctccctggctgtctgtgatcactatgcaagtggcagcagagttggcaaagagatggatagcagtattaataagtggctcagtggcctcaggacggaggaaaaacctcctttccaaagtgactggtctggaagttccagagggaagtacaccagatcgtccctgctcagggagacagagtctaaatcctccagttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagatcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaagatcttccagaggggcagagccaaaatgagaggtaccaagcataagggcagcagaggtggagtagggaggaggcaaggagggggagaaccatcaatacgaatacgaggtccgaatgctggaccaactgataccattttctgttgctcagcgccctctaagctttggtgtttcacttaatgtatttgacagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgattttttttttttaatgttttgagtctccattaaaaatggtatgttggcaaaaaaaaaaaaaa

SEQ ID NO: 157 - DNA, 1225 bp, Homo sapiens
  CDS (132)..(881)
tttcgtctctcgctcccagcgccacggacgcccccgggccgagcggcggtgcgctcccgtgcagacccgtggacagacgcccctggccggtggactctcgagtctcgcttctgcaccctgcgtccccagacatgaatgtgaggagggtggaaagcatttcggctcagctggaggaggccagctctacaggcggtttcctgtacgctcagaacagcaccaagcgcagcattaaagagcggctcatgaagctcttgccctgctcagctgccaaaacgtcgtctcctgctattcaaaacagcgtggaagatgaactggagatggccaccgtcaggcatcggcctgaagcccttgagcttctggaagcccagagcaaatttaccaagaaagagcttcagatcctttacagaggatttaagaatgaatgccccagtggtgttgttaatgaagaaaccttcaaagagatttactcgcagttctttccacagggagactctacaacatatgcacattttctgttcaatgcatttgatacagaccacaatggagctgtgagtttcgaggatttcatcaaaggtctttccattttgctccgggggacagtacaagaaaaactcaattgggcatttaatctgtatgacataaataaagatggctacatcactaaagaggaaatgcttgatataatgaaagcaatatacgatatgatgggtaaatgtacatatcctgtcctcaaagaagatgctcccagacaacacgttgaaacattttttcagaaaatggacaaaaataaagatggggttgttaccatagatgagttcattgaaagctgccaaaaagatgaaaacataatgcgctccatgcagctctttgaaaatgtgatttaacttgtcaaatagatcctgaatccaacagacaaatgtgaactattctaccacccttaaagttggagctaccacttttagcatagattgctcagcttgacactgaagcatattatgcaaacaagctttgttttaatataaagcaatccccaaaagatttgagctttcagttataaatttgcatccttttcataatgccactgagttcaggggatggtctaactcatttcatactctgtgaatattcaaaagtaatagaatctggcatatagatttattggttccttagccatgggaatattgaggctttcacatatcagtgattttaaaacataccgggtttg

SEQ ID NO: 158 - DNA, 877 bp, Homo sapiens
  CDS (241)..(363)
tgctgtgccgcgcatctaggcagcagcttccgcggatcattagccgacgagggagggagccatgaaacatgactaggtaagaagcgagaaacaggggccgtgtggccactgctgacccattctttttccttctttgcgggaccacgggaccccactttctggtcctgtgccccgaaggaagagccagacggcgcaggcgcagtgggcaagcgttgcgccccgggccactcgtaaattccaatgcgcatgtgcgcaggaagtatttataaatctgcaacccaggctgttttgggggtactttttcttgggggtctctgcaggggctgggacgcttgcaggttccttgcagctcccccagcgggctgagttgcagactttgtcatgggagccacgaaggtgcgggacccttgctcccaatccgagggagtcttgcacaaatcttgcgccacgccgccgtcaccagcgtaggaaggggctttgctatcagtattcttgtgtacgacctttggaccccttccctcgcccgggacgttcccgggagacttaggcggtgagggaggtgcagctccacggctggctttcgcagagcggcgaagctgatcttgccttctggttatcaaagaggtcatctacgtcaacccttgggtgtcaccaaggagaaatcttatacccacccacagccactcttgaagcccaagtcttctgactcctaacttgggtctctttttcccttaaaacgaagtcttctgatgtgcttatcgccctaggtgataatataatattaataattcaaccaattatccctgaattattgctgacttttaagtaactatcatcaaataataaaatttgttattaaaattcaaaaaaaaaaaaa

SEQ ID NO: 159 - DNA, 762 bp, Homo sapiens
  CDS (212)..(646)
  misc_feature (1)...(762): n = a,t,c or g
gcacgagctcgcgcngaaccccaaggtgacatccttggtgagacaattgtgggcagcctgacacccagtgagattcagcagctgctgcggggtccccacgggctgccctgagcagacgctgagctccctgacgcccgtcatcatcctgtcccgctatttggataccaccggccagtggggcaaggtcggggtggagcacagggaccaggtgatgaagaatattgtcagcggctacactcggatgctgacccaccggagttcagacggcacctaccacacctccaaggggaacccaggaagcacttggatggctaccaaggcctccgaggaggatgtatccctcacagctcttgtcctaatagccctgaatgagggaaaggagttgtgcagacagaagaatttgatggccagcatcgagagagcccgtggcttcctggagagaaaacttcccgacattcagacaacctttgccgtagccatagcctcctatgcactggcccttgccaacagctcccaagccaacgactgcctggacagctttgccagccctagtgggtgtgggatgcttcttaatcaacctcagtcatggagtggggagggggtgatctcaaatccagcaatgtgttattcatcacttagtgtttcctgagcatccactgtgtatcacctcctgagctcagaccctgtgagaccaagacaaaacccactggccagtggatgagcagaatctgggctccctgtcacaatcactagtgcgaccgc

SEQ ID NO: 160 - DNA, 3778 bp, Homo sapiens
  CDS (74)..(3775)
cgggtcgacgatttcgtccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcaggtaatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacttcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctacaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctga

SEQ ID NO: 161 - DNA, 4417 bp, Homo sapiens
  CDS (168)..(2240)
gtgtcagccctagtcattcaggagattattgcagaagtttccaaactgaagcaagctgtgcccaggtccctgtaacagcaggtggctttctgacatcagcagagactggtgctttttcccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaataagaagcagagctgtgcaaagcagggagcacacaaacaccaaacaggatgaagaacaggtcacagttgagcaggattctccaagaaacagagaacacatggaggatgatgatgaggagatgcaacaaaaagggtgtttggaaaggaggtatgacacagtatgtggtttctgtaggaaacacaaaacaactcttcggcacatcatctggggcattttattagcaggttatctggttatggtgatttcggcctgtgtgctgaactttcacagagcccttcctctttttgtgatcaccgtggctgccatcttctttgttgtctgggatcacctgatggccaaatacgaacatcgaattgatgagatgctgtctcctggcagaaggcttctaaacagccattggttctggctgaagtgggtgatctggagctccctggtcctagcagttattttctggttggcctttgacactgccaaattgggtcaacagcagctggtgtccttcggtgggctcataatgtacattgtcctgttatttctattttccaagtacccaaccagagtttactggagacctgtcttatggggaatcgggctacagtttcttcttgggctcttgattctaaggactgaccctggatttatagcttttgattggttgggcagacaagttcagacttttctggagtacacagatgctggtgcttcatttgtctttggtgagaaatacaaagaccacttctttgcatttaaggtcctgccgatcgtggttttcttcagcactgtgatgtccatgctgtactacctgggactgatgcagtggattattagaaaggttggatggatcatgctagttactacgggatcatctcctattgaatctgtagttgcttctggcaatatatttgttggacaaacggagtctccactgctggtccgaccatatttaccttacatcaccaagtctgaactccacgccatcatgaccgccgggttctctaccattgctggaagcgtgctaggtgcatacatttcttttggggttccatcctcccacttgttaacagcgtcagttatgtcagcacctgcgtcattggctgctgctaaactcttttggcctgagacagaaaaacctaaaataaccctcaagaatgccatgaaaatggaaagtggtgattcagggaatcttctagaagctgcaacacagggagcatcctcctccatctccctggtggccaacatcgctgtgaatctgattgccttcctggccctgctgtcttttatgaattcagccctgtcctggtttggaaacatgtttgactacccacagctgagttttgagctaatctgctcctacatcttcatgcccttttccttcatgatgggagtggaatggcaggacagctttatggttgccagactcataggttataagaccttcttcaatgaatttgtggcttatgagcacctctcaaaatggatccacttgaggaaagaaggtggacccaaatttgtaaacggtgtgcagcaatatatatcaattcgttctgagataatcgccacttacgctctctgtggttttgccaatatcgggtccctaggaatcgtgatcggcggactcacatccatggctccttccagaaagcgtgatatcgcctcgggggcagtgagagctctgattgcggggaccgtggcctgcttcatgacagcctgcatcgcaggcatactctccagcactcctgtggacatcaactgccatcacgttttagagaatgccttcaactccactttccctggaaacacaaccaaggtgatagcttgttgccaaagtctgttgagcagcactgttgccaagggtcctggtgaagtcatcccaggaggaaaccacagtctgtattctttgaagggctgctgcacattgttgaatccatcgacctttaactgcaatgggatctctaatacattttgaggtcagccacttctccagtggaactctgaagtacagatgctgaattttctgctttggaaagaaaaaaaaaagaagctattgtccacagattgatgcttccataatggaatcagctttaattgcaaggaatgaagaaaaacaagagtggaccttcaaagctacaacattttcctcctcccctccctccccaccagccccttccccaccaagaactgctatgatgtcccaaagtgaggtgttgttgattccagtctcaatgggattttctgactttaatgtttgcaaggcatttcaccagaatacagctataaacggccgctcccaacaactgggctctgactcacccacacccacttagtgtccactaagtagtccagggtgactcagtttaagcacatctcaggtgaggtcactctgcatataccttggcttacctgaaatagcctgaacttgaatctcacataagggaaaactagtcatcaatcaccaactcattgactaccctcaggaagtcctgcagaaatcaagagtccttgaggagaacacgtggatcataccaaaaccagggtttaaatccattctgcttaagagttctatcagtcagtttaaccataaattacgctacagaaacaaacaacccaaaaacctcagtggcttacagatttatttttcactcacatgtttgtaatgatccatcttggttgtaatccatattgcttcagcacccagtctaaaggagcagcctctaaggggggcatgttggtcttaagagggaaaagaaaggtgggaaccacatgatggctctttcatcttccgctaggaaatgataccctttacttccatgacattccattagccaaaacaagtcctgtgacaggcacgatgtcagtcaccacagttaaattatcctgtcatagggagggatagtgaatattttgcagaagtaatatgatacaccataagggtacataatatccatgtctcccttcaaggagccatcctgttgtaggccataacggtaggcctattcatctgcacatttggtaatgtattcctggtgacaaagcagctactcttcaatcaaaagccgtgtaagaagcagttgaggaaaaaaagtcctggttgagctctgaaaaccttgcgttgataatttcattgaccaggatggcatcagtatcaaacttgaagaatgggtgtcagtgtctaagaaaaagattccagagacaatggtggtgtgctctttaacgaaatgcccatcaccactgctcttaatagcatgaagaccacatgctgtgagaaaacacaaacatcaattaccaagtcaagaaacagacactgaatgtgaaaaaggttttgaaataccttaagtaatttattttgtttctatttttccttctgtttgtgtacaagagtaatttaaaagaaaaagctatgtgaaaatagttggggttttttgtgtgttttgttttttgtggtggtgaaggaggaggcctaatgtccagaggactgtttatccctgaagtatgatatactaaaatatttcttattatttgtatcaattttccttggagctcaatgtgcccttgcagtcttcagactttattttaggaaaatatatttgcatgttttccccccattctcaatgtttggtgtcctggttcatcataccccacagaatgttatgtttatgtatcataccattcctctgtggacatgcatttactttgtttacaggttttggtttgggggttctctttttcctactctggacagtgcatgtacatttactttgcatgctggtgcttttttttctatagcaatagtgtctgatagacatatgcaagtcacatgtaatttaagatctagtagccacgctaaaaaacaagtaaaattaattttaatatatttaactcaatacattggagatattatttcagtaagatatttttcattcttatgaaactaagtctgtctggtttgcatatctcagttgagacactaaagttttactgataatacttaatccatgtttagatttcataaaatctaaatttgcaaagtaaatttacatacccatgttggtctaaatgtgcttaaaagttttccaataactgaaatgagtatcagttttaaatttaaaaatttgttacttggttactccatatttcaggtat

SEQ ID NO: 162 - DNA, 556 bp, Homo sapiens
  CDS (37)..(450)
cagtggtaacaacgcagagtacgcggggtcggtaccatggcgacgcgcggtggggctggggtggcaatggcggtttggtccctcttatccgcccgggccgtgaccgcgttccttctgttgttcctccctcgcttcttacaggcccagaccttctctttccctttccagcagccggagaagtgcgacaacaaccagtactttgatatctccgccctctcgtgtgttccttgtggagctaaccagaggcaagatgcccgaggaacttcatgtgtatgtctaccaggatttcagatgatctctaataatggaggacctgctattatttgtaaaaagtgcccagaaaacatgaaaggtgttacagaagatggctggaactgcatttcttgccctagtgacttaactgccgaaggaaaatgtcactgtcccattggccatattttaggtaagaattagattccttataaagaagtagtgataaatcttcattcttgtttttgtttttatttgaaaagggcactaatttaaatagttaagtgattacttaatatttttgcag

SEQ ID NO: 163 - DNA, 6131 bp, Homo sapiens
  CDS (316)..(2058)
gtccacccccgacgctctgaggtcaccgactgggccggcccgcggggggcggagggacggagggaagatggcggcaggggccggatattggcgccgcctcccccaatcccggagccggcgcagatgaggcagttcggctggggccagcggcgctttggaacccgaggtggggggaccctggcggtggggcctggtcctgctatatgccggcgcctcggctagagtgagcggcggcgacgcctctttcctccatctctttccctgtcgctgcgagagcgagcgggcggcggaggcggcggcggcggcggggccgggatggaggacgttaactccaacgtgaacgcggaccaggaggtgcggaagctgcaggagctggtgaagaagctggagaagcagaacgaacagctgaggagccgctcgggggccgtgcagggcgccggctcccttgggcccggcagcccggttcgggccggcgcgtccattccctcctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggctgtattcatcaccaaagaaaaaacttacaccaatgcagaaatcggttagtccattagtttggtgcaggcaagttttggattacccaagtcctgatgttgagtgtgctaaaaaatctcttatccacaaacttgatcaaactatgtcagctctcaagaggcagaatttatataataatcctttcaactctatgagttacaccagtccttacagtccaaatgccagtagcccatacagcagtggcttcaattctccatcctcaaccccagtgcgacctcctatagtcaaacagcttatacttcctggaaattcaggtaacttgaaaagctcagacagaaatcctccactcagtcctcagtcctctatagatagtgagttaagtgcttcagaattagatgaagattcaattggatccaattataagctaaatgatgtaactgatgtacagattctagcccggatgcaggaagaaagtctccggcaagaatatgcagccaccacgtctcggcgcagttctggttcatcttgcaattctacaagacggggtacttttagtgatcaggaacttgatgcacaaagtttagatgatgaagatgacaatatgcatcatgcagtataccctgctgttaacaggttttcaccatcaccacgcaattcacctcgaccgtcacctaagcagtcacccagaaattcacctcgttcacgatctcctgctcggggaatagaatatagtagagtgtccccacagcctatgattagccgcttacagcaacctcgcctttcacttcaaggccatcccacagatttacagacaagcaatgttaaaaatgaagaaaaactaagacgcagtcttccaaacctgtcccgaacatctaatacacaagttgactcagtgaaaagcagcagaagtgactcaaattttcaagtgccaaacggaggaatacctcgtatgcaacctcaggcttcagccataccttctccaggcaaattccgttcccctgcagcaccatctcctttggctcttcggcaaccagtgaaagcatttagtaaccatggctctggttctcctggtagccaagaaataacacagctcacacaaaccacctcctcacctgggcctcctatggttcagagcacagtctcagcaaatcctcccagcaatatcaacagcgctactctaaccagacctgcagggacaactgcaatgagaagtggcttgcccagacccagtgccccttctgctgggggcataccagtgcctcgcagcaaacttgcacagcctgttcgcagatccttgccagctcctaaaacctatggtagcatgaaagatgacagttggaaagatggctgttactgaccagcaaagacaagaatgcagaagtccacggcttcatggatacccttcaccaggctaaaaaacaacttttatatgcagactgttcagataagactcttgggatttataaaatcccagccctctctgtcttaattagcacaaaccgacagagatcatcaaacagcactttaatgacatttaacatcagatgtgtttggtaatcatacaatcactctccatagaatcacttttagttttgtttaatagaaactaggttgatttttaaaaaatatttgacagaggccaatatctgggcaaatacctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtacaggtgtccatttttgacgttaagcatggtcctttaaggtcacatgacgtttgatttgcaaacatttctatagccgaacttgtatatgtggttgcctccttaataaacagcctgaccataatgtttattattaaatttatattctttaagtgtttaattaatctctggatatggtaagattcctttttttcctctcagttgcctacacttggttttaataaattactcagttgagtttttctttaaccacagaaacccaaatcatattgccctttcagatttagtcttcatggggttggattatgtcttatattttctctgtcagagttatttcatatatggattttacttgaaggaaatttatagtttactctaaattgatttgttcttggaacttttttacctgctgtgaattgatacctagttataaaaagctagcatttgcctagatcataactatgtatggtatctagttagaaaaaaacaagcaaaaagctattatgagtttccaagagggacaattaatgcattttcataccaaatgcgaatatttaggtgatcacgtgcatcttttcttgtatggatggaaaaatcaagaattgtacactgtttaatgagttctccatattcctttaggagatatttgctttgcaattacatgttacaattagaataattacaattaaaataatattacatgttacaattagattaatagtgatgagagggaaaaaagacacccttctgtttttttctctcaagccagtctaaaaacttgaagagccatttaaaattaaatgtcactatacttgtattataaatcaatacataagtttaaacctgttatatactcagtgcaacagaaaaacccatatggaggttcaaccactgatgtattttgaatgatcctaaatataagtcttgggtggctaaatggccctctgcttaccagtctgaaaatgaaaccgattatactcatcggccttatttactgtaatacaaactggttaaaactatgttaactgaatgctagtttgaaacaaattatctacattaagtcatcttaatgttttctctttaaaagaaataaaaaaatctgtttcttctgatttcgaaagtaatagaaactctgctgtagaacataaactaaaaatattaaaaagtataaaggtaaaaaatgatagttgtctgcaatcccataatccggaaatattgaagtactgtccgtaacatggttatgacatgttaagtggaagggtagaaggtc

SEQ ID NO: 164 - DNA, 700 bp, Homo sapiens
  CDS (125)..(505)
gcacgagcagaggcggacgcccagcgctgcagagagaaagtgacgagccgcccttcgttgtcagccaggaacgcggacacagcggcgctcccaccctgctgctgtcgatccctaggccgccgcgatggcagctgccggcgcccgaggcctgcggtccacctaccaccgactcatggataaagtggagttgttgctgccaaagaaattgaggccgctttacaaccacccggcaggccccagaacagtttttttctgggctccaataatgaaatggggattggtgtgtgctggactagcggacatggccagacctgcagagaaactcagcacagctcagtccactgtgttgatggctacagggtttatttggtcaagatattcacttgtaattataccaaaaaattggagtttgttcgctgttaatttctttgtggggtcagcaggagcctctcagctgtttcggatttggagatataaccaagaactcaaatctaaagggatccagtaagagagttcctgatcacctgaacattctagatgtggacagaaacattggaacctagtgtatttgcttaccgataaggtgatgctaaattctgataacattcgaaaagaaggaaagcaaaatctaactgtacttaaaagctagcacttgacttcacaaaaaataaagcaaacttttagtaccaaaaaaaaaaaa

SEQ ID NO: 165 - DNA, 2746 bp, Homo sapiens
  CDS (787)..(2043)
atggagggccttgtcagccacagtaaggaatgtggacctggtcctcagggtgaaaatgattgctgttatatgacacactggttaacaaaggagggggctgtttgcaaacagaaacaaccaacccagggcctccagccatccaaagattctgcacagccagccacccctaaggctaagaaatcccagactctcctgagactccaagcagagaagctgttgtcatcagcaaagaattctgaccatgaatactgcagagagaaaaatctcttgaaggcagttactgactttccatcaaatagtgctttaggtcaggccaatggtcacagacctaggacagacccacaaccttctgactttcccatgaagttcaatggggagagccaaagtccaggtgagagtggcacgattgtggtcaccttgaacaaccataagagaaagggcttttgttacggctgctgccaagggccggagcaccacaggaatgggggacccttgattccaaaaaagttccaacttaaccaacatagaaggataaaattatctcctcttatgatgtatgagaaattatccatgattagatttcggtacaggattctcagatcccagcacttcagaaccaaaagcaaggtttgcaagctaagaaaagcccagcgaagctgggtacagaaagtcactggggaccatcaagagacccgtagggagaacggtgagggtggcagttgcagcccatttccttccccagaacctaaagacccttcttgtcggcatcagccgtactttccagatatggacagcagtgctgtggtgaaggggacgaactctcatgtgcctgattgccacactaaaggaagctctttcttgggcaaggagcttagtttagacgaagcattccctgaccaacagaatggcagtgccacaaacgcctgggaccagtcatcctgttcttctcctaagtgggagtgtacagagctgattcatgacatccccttaccagaacatcgttctaataccatgttcatttcagaaactgaaagagaaattatgactctgggtcaggaaaatcagacaagttctgtcagtgatgacagagtaaaactgtcagtgtctggagcagatacatctgtgagtagcgtagatgggcctgtgtcccaaaaggctgttcaaaatgagaactcataccagatggaggaggatggatctctcaagcagagcattcttagttctgagttgctggaccacccttactgtaaaagtccactggaggctcccttggtgtgcagtggactcaaactagaaaatcaagtaggaggtggaaagaacagtcagaaagcctctccagtggatgatgaacagctgtcagtctgtctttctggattcctagatgaggttatgaagaagtatggcagtttggttccactcagtgaaaaagaagtccttggaagattaaaagatgtctttaatgaagacttttctaatagaaaaccatttatcaatagggaaataacaaactatcgggccagacatcaaaaatgtaacttccgtatcttctataataaacacatgctggatatggacgacctggcgactctggatggtcagaactggctgaatgaccaggtcattaatatgtatggtgagctgataatggatgcagtcccagacaaagttcacttcttcaacagcttttttcatagacagctggtaaccaaaggatataatggagtaaaaagatggactaaaaaggtggatttgtttaaaaagagtcttctgttgattcctattcacctggaagtccactggtctctcattactgtgacactctctaatcgaattatttcattttatgattcccaaggcattcattttaagttttgtgtagagtgtattccacaacagaaaaacgacagtgactgtggagtctttgtgctccagtactgcaagtgcctcgccttagagcagcctttccagttttcacaagaagacatgccccgagtgcggaagaggatttacaaggagctatgtggctggagagaagagggaaggtaatagagacaacttagtcccatgggagcgcagcaaccgtgtcaggttctttctcctgtcccattagtgacctcagtaacatgcagggtacgtctggcttctgcatggccagtgctgacactagcacagctgttcttctccttctgttgaacctcatcttctgaagaaaggccaagtggcccttgtccatacacttagctgcattaggatgaatatcacgcgtctcacatctttaatccagcctttcgtgacatgttggaaagatacatgtgaaacctacccagttaccctttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaaaaaaaaa

SEQ ID NO: 166 - DNA, 1219 bp, Homo sapiens
  CDS (417)..(1109)
acgtcgggtctccgcggcccgggttattgtacgaaccatccggacccgcgtaatcgtaggaactatcggccccgcgtaatcgtatggtctgcgcgggtcccggcctcccatcagagctgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtgggccaggagatgaaggctgagtactgggcagtctcatctctcactggtgaaatggtccgagaatctctccgggggggccggcttgggcatggtggctgcttggaaacgggccacctgggattgggccctcaagggtgaggccttttttggggaaccttgtccggggggggaataccgcggggggccctccacagcgcgtgtttacacctgggcgggggttcccgcgacacccgggtgtggtgtac

SEQ ID NO: 167 - DNA, 1643 bp, Homo sapiens
  CDS (1)..(1260)
atgtggtggagagatttgacgagactgagactctggttgaagagagaggcaatcccaggagaggggcggaaagcggcaaaggttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagagctctgctggtcaaatacttgactcccacttcagc

SEQ ID NO: 168 - DNA, 2170 bp, Homo sapiens
  CDS (194)..(1165)
cgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataaatgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcacgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggtttgatcaataaacacaatggtattccaaaaaaaaaaa

SEQ ID NO: 169 - DNA, 3543 bp, Homo sapiens
  CDS (313)..(3540)
gtgcgcgatcgctccggaattcccgggtcgagctgcctgggactcaactcgcagtcccacctgcccggttagggtctgcaggatggagagcgtgttcaaggtggtcgttttgcccacttctcatggcaaccctctaggggaggcaccattagtgtgcccatttcacagggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcagggccagtctgactgtctctgtctctggctataggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaa

SEQ ID NO: 170 - DNA, 1791 bp, Homo sapiens
  CDS (227)..(1468)
gggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccaggtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctccaggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttaaaaaaaaaaaa

SEQ ID NO: 171 - DNA, 545 bp, Homo sapiens
  CDS (15)..(341)
  misc_feature (1)...(545): n = a,t,c or g
aaggggagcaagctatggaggggaacagggatgaggctgagaaatgtgtcgagatcgcccgggaggccctgaacgccggcaaccgcgagaaggcccagcgcttcctgcagaaggccgagaagctctacccactgccctcggcccgcgcactattggaaataattatgaaaaatggaagcacggctggaaatagccctcattgccgaaaaccatcaggtagtggcgatcaaagcaagcctaattgcacaaaggacagcacatctggtagtggtgaaggtggaaaaggctataccaaagaccaagtagatggagttctcagagctttatggatattggaacattgatatgggatggtggacctgtacctaacacacacataaacaaatgtaaaaattactatgaagtacttggagttacgaaagatgctggtgatgaagatttgaaaaaagcttatagaaagcttgctttgaagtttcatccagacaaaaaccatgcccctggagcaacacactgcttttaaaggtaaagtttccctttatgngacg

SEQ ID NO: 172 - DNA, 2183 bp, Homo sapiens
  CDS (777)..(1196)
aggacttcggaaccgccccgtcctcaagatcgaaaagcccagagccgcgcgctcaagcacggtgttgggggtggggtctcaggagcgcccagcaaggcgcccctgtcggcgtggacccgcgggctcaaaggcagttccccggtgacccgcccagcccctctatgcgaactcgaacgacagcaccacagcccgccagcgtcgagactcgcgctgtgccccaacccaggtgggcgccgcggagccgcgagcctgagcccgccctgcaggtgacccgcggcccttcctcctccaggtaccccttctcctgcggccccgtcccctataggtaacctttacctcccgcggctccttcccctccaagcgacccgcagcgcccgggccctccaggtgactgcgcccccgccaacccccgccccaccacacacacacaccccctcgccttcttccgccctactccctccaggtgaccccacccccgcagctcctcctcctccggacaacctgcagccccgcccctgcaggtgaacggcggcccagtccctgcaggtgacccgcggaccctccccgcccgtcctactaccgtcataggacgcctccgcaggcgcactggagccgattgcgcaggagccgattgcgcaggcgtggctctcacacgcgctgccctgttggcgttggtgcgggactgcgcaggcgcgcgggggcaagactggcagtgcgcctgcgccgcgtcggcgtgcggaacgccgcggtgtctcggcgcctctgcgcgcgggaagatggcggaacaggctaccaagtccgtgctgtttgtgtgtctgggtaacatttgtcgatcacccattgcagaagcagttttcaggaaacttgtaaccgatcaaaacatctcagagaattggagggtagacagcgcggcaacttccgggtatgagatagggaacccccctgactaccgagggcagagctgcatgaagaggcacggcattcccatgagccacgttgcccggcagattaccaaagaagattttgccacatttgattatatactatgtatggatgaaagcaatctgagagatttgaatagaaaaagtaatcaagttaaaacctgcaaagctaaaattgaactacttgggagctatgatccacaggtgtaccagcagtgtgtcaggtgctgcagagcgttcttggagaaggcccactgaggcaggttcgtgccctgctgcggccagcctgactagaccccaccctgaggtcctgcatttctcagtcggtgtgtaatcacgttccagggcccaaagcccagctctttgttcagttgacttactgtttcttaccttaaaaagtaattgtagatggaaatcagttgtgtttggcaggagaatcaataaaaatctttgattcagacagcttatggggtattttaaagcattcttagactagttgaacatctcactttgccccagttacaaaaatagtagaacaagcaacataaaacaatgaaggaaaacctcacttgaaggcccaggtcaacatctaagcctgttgagacttagataatcgagtctacctcttcagtaggtttgtgtggatggcctggaggcaggtgcttgctccccagtgctacctctctcttccctagggccttttgtggattgacagtagtcccctccgtagagctcacagtctagattagaagtgttttaatttctacacacccatagtgcacacttgtatattgaaaagatagggaagagagaaacatttatggaatcagtcgttggcaccttcaatacttcatgatttttgtcgagtttacttcatgaggaggtcagcccattggctcccatctgaaccactttgcctctgaaacttaattacatccagaaagaaggacacttgtatgctagtctatggtcagttgaggaatatgactgtttttatatgcacatgtaacccaaatgtccaatataaattggcttattttttaaaataattttaaaagttgggaaaagtgttattatttggcatgcttaaatattgaataagtattcttcatcagcatttaataaatgtataggcagatgtaaggtaatttctgtgtattttgagataatgtcaaaatcatgaatatttcaaaataaactggggagttataaaaatacaactagagatataaaaaaaaaaaa

SEQ ID NO: 173 - DNA, 1255 bp, Homo sapiens
  CDS (1)..(1128)
atgtgtcgggctaccctcgggcttcccctgccgcccattgtgatccagcccgctaggcgctccctgccgcccattgtgacgcctgccagccgcaggctgggtccccgaggcgggcggcatttaggctcggtctccacagccatggccgcgacgcaggagctgctgctgcagttgcagaaggataaccgagatggtcgccagcggaagcaggagctagagaagctgatgcgcgggctcgaggccgagagcgagagcctgcctcaaccagcgcctgcaggacctgagcgagcgggagcggagcggacccaggtgggggactcggccaggacttcccagtcctcaatcatgagcctgcggctggtccttcctggcgactgcgggatcctgagcgacccagtccgccttgtagcgccaacctcagtttccctctgcaggctgctgcggaggcgaagccaggaagcgctgcttctgcaaggggaggtgcgcgaggcggcgcgggagcgcgcgcagcgggtgcgcagaagactggaggaggcggagcgccacaaggaggacttgctcttctactacggaggggaactgcagagccagaagagcacggagcagcaactcgcagcccaattggtgacgctgcagaatgaactggagctggcggagaccaaatgcgccttgcaggaggagaagctgcagcaggacgcgctgcagacagcggaggcctgggccatattccaggagcagaccgtagtcctgcaggtgcggccccactcagacgccaaggtgcctcccgcctctcctcccccagacctggggcggtgtgacgggcagcttcgcggagtgcagtacagcaccgagtcgctcatggaggagatggccagggcggaccgagagacgcggctgttcggcggccctcgcgcgctggccatcaggcggtgcgtgctgggcgcgctgcaggtgctgctgacgctgccgctcctcttcctggggctgtcgctgctctggacggtgctgttggaccccggcgccgtctccgcgtggctctggagcctcacctcggagacgacgctgcgccgcctgcgctacacgctgtccccgctgctggagctgcgcgctaacgggcttctgccaacctaagtgcagcgccccgcgcctggctccaggtggactccagggcacctggctttatttctggtgcactcctctcctgagagtgtagaccaaggttgcctaataaactcaagggatgaaaaaaaaaaaa

SEQ ID NO: 174 - DNA, 1044 bp, Homo sapiens
  CDS (151)..(1041)
gattccttcctttcccctttcatttttccactgtgggtgttattatcctgacaatttgtcatacatttcctgtctttaaaaaataactgtatactaagcaaaactcaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagaactgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggaattactgaaccttcaacatgcctactataaactaaacagacaataccaggcaaatattgcagaactgactcatgcaaacaaccgagtggatcaaaatgaagcagaagtaaagaaactaagattacgagtggaagaactaaagcagggactcaaccaaaaagaagatgagcttgatgattccctgaatcagatccgtaagctccagaggtctctggatgaagagaaagaaagaaatgaaaacttagagactgaactcaggcacttgcaaaactggtaa

SEQ ID NO: 175 - DNA, 2291 bp, Homo sapiens
  CDS (1)..(1938)
atggacggtgaggcagtccgcttctgcacagataaccagtgtgtctccctgcacccccaagaggtggactctgtggcaatggctcctgcagcccccaagataccgaggctcgttcaggctaccccggcatttatggctgtgaccttggtcttctctcttgtgactctctttgtacacaaagtccccaggggccccagatgcacactctctgggcctctctgctcccagaaagatcattccacctccagctccaggcccaagccacagcttccctgggaacagataaaggccactgtccaagggggagcctcccaagaactgaggttcatgagggaaaccctgggagggtctttgctgctatctccccggttctggaactctacctctgtgtgggacagcgtatcctcccaggctcagggctggggatttgctgacctggaaaaatggaatgtctcagttcaacagcagacaagacctgttccgaagcctgtgcaagccgtaattctgggagacaacattactgggcatttaccttttgaacccaacaatcatcaccactttggcagggaggcagaaatgcgagagcttatccagacatttaaaggccacatggagaattccagtgcctgggtagtagaaatccagatgttgaagtgcagagtggacaatgtcaattcgcagctccaggtgctcggtgatcatctgggaaacaccaatgctgacatccagatggtaaaaggagttctaaaggatgccactacattgagtttgcagacacagatgttaaggagttccctggagggaaccaatgctgagatccagaggctcaaggaagaccttgaaaaggcagatgctttaactttccagacgctgaatttcttaaaaagcagtttagaaaacaccagcattgagctccacgtgctaagcagaggcttagaaaatgcaaactctgaaattcagatgttgaatgccagtttggaaacggcaaatacccaggctcagttagccaatagcagtttaaagaacgctaatgctgagatctatgttttgagaggccatctagatagtgtcaatgacttgaggacccagaaccaggttttaagaaatagtttggaaggagccaatgctgagatccagggactaaaggaaaatttgcagaacacaaatgctttaaactcccagacccaggcctttataaaaagcagttttgacaacactagtgctgagatccagttcttaagaggtcatttggaaagagctggtgatgaaattcacgtgttaaaaagggatttgaaaatggtcacagcccagacccaaaaagcaaatggccgtctggaccagacagatactcagattcaggtattcaagtcagagatggaaaatgtgaataccttaaatgcccagattcaggtcttaaatggtcatatgaaaaatgccagcagagagatacagaccctaaaacaaggaatgaagaatgcttcagccttaacttcccagacccagatgttagacagcaatctgcagaaggccagtgccgagatccagaggttaagaggggatctagagaacaccaaagctctaaccatggaaatccagcaggagcagagtcgcctgaagaccctccatgtggtcattacttcacaggaacagctacaaagaacccaaagtcagcttctccagatggtcctgcaaggctggaagttcaatggtggaagcttatattatttttctagtgtcaagaagtcttggcatgaggctgagcagttctgcgtgtcccagggagcccatctggcatctgtggcctccaaggaggagcaggcatttctggtagagttcacaagtaaagtgtactactggatcggtctcactgacaggggcacagagggctcctggcgctggacagatgggacaccattcaacgccgcccagaacaaagcgtgagtctagccaccatctggcgctgtcccaggcactgtctttggtggacctagctacacactgtgtgtcccttcccagtaagtggtagtgttgtgtgtatatgtgtgtgacgtgtgtggtgtgtatgtggtgtatgtgtggtgtgtgtgccatgtatgtggcatgtgtaatgcatgtggtgtgcgaggtgtatgtgtggtatgtgtgtgatgtgtgtgcgtttggacacacaggtgtggtcatcgctctcacctggactcctccacagagggtcattaggaaaggacaggtcctgaggctggcatgcagccagtgagtgggtctttctgtttttttccccctgccctactcag

SEQ ID NO: 176 - DNA, 570 bp, Homo sapiens
  CDS (337)..(501)
  misc_feature (1)...(570): n = a,t,c or g
cacaagtatagaaagctttgtagttctgactcagaaaaataacaattaaatcttccctctgcctttcctctttcttttgattcacttgactcattcagatgttcctataaagaagcaatttaagtctctatagctttacacagaactggtggtttcttctcttgtatcccaagcagttagtacatacatctagttaggaatgatcatctaatttatcagcagacctagacacaactgagaatgaaagaagacacaaataactattaagccaggacaagagattcctgataaatcaggaaatatggtcatactactttgaatgtagttatctattaaatgtgtctcttgtcattcaactgtaaagctgtgttaagtttgagccttatttctcttagcttcctttgttgcctggaattgtgtctggcacgttgtggtggcagaagaaatgttagtgcccctttaaaaatgttcatttatttaaaccattatactatattgatgtaggaactcatacccatcccatttgggggncctttttatgagnccattttctccagtatttccaaatgt

SEQ ID NO: 177 - DNA, 1193 bp, Homo sapiens
  CDS (957)..(1133)
caagtcctttcatgttatagaacattacatttgtcctttgcagctggtatctttagtttaaagaccagtgaaattcttaaccatgttcccattttaaaacaaagcgaacataaaaaatgactaattcttagaactgaagttctaggttttgctttaatagcttttaagtattgccacttataaccccattattaacaccacagtctgcatcaaaagcttacttaaaacatttagttttcatgagagtttcccaaaaataatttcataacaatcatttgttctaagagccatttcttaactcatcatgaactgtaatagattatgaagataagtttcaaaatttacataccagattttttaaaatgaagttaaaaggatggacatattgagggtcttatgcatgggcatactgaagggtttggagagacagaatgtgcatgaggtttgagaaggggagcatcacttccctatgtggaaataggaacggagcagcgttcattgtgtgggccttgagcccctcatccctttcactctaaggctggaagccacagcctgatgttctaaccatttgaacacttaacatttgttcaaagcctggctttgtaatcatttgaacattccattacatggaaggaacatggacttcatgtcagctctgcattttaaatcattcctccacagtgacttgacaagttattttacctcttgtctactggcccttacaacattttgtgtagtatatgtgttgggcaaataggatttatttttaccattgcaatccagacttcatattggaacgcactcaatattcagaagtttgaattctaccactctcaaacacagttcaaaagatagctgtttgagaatgcttcttaactaatactagtacaatatcttcaataatgtatgtaccttatagaaaatcttgaacagtacaagattttcataattaaggcatgcaaaactgcttgggctctttgattccaggtgtcctcttctcccttctgcttttgccatctatgttcaatataattctaacccagtctaagtatggagaaaattcctaccctgcctgcttttatagctcatcaaatttccctgtatcagctatcacttttctggtaggtgtagtctgatttctgtctgtcatgcctttgccacaatcctttctttgaagagtaggtaaaatgatg

SEQ ID NO: 178 - DNA, 1113 bp, Homo sapiens
  CDS (536)..(835)
tttcgtctggccacccccacagcccagagcactggcatcatctgtactatcggcctagtttcctgattgggggaaatgttgatgattaagtctggaattaatatggcttgtctgaacttacgagtaccacgcagagaccatcaggaatgtgtgcacaactatggaaagccttgcttctgaccccaatctctagcggctagttgctgtggctctggacactaacgggcctgagatctgaactgggctcacacagagcagtgtccccatggaggtggagctgaagaagggagccaccttcagatcacactggataatgcctacatggaaaacttatgatgagaacttcctgtagctggactacaagaacatttgtaaggtagtggaaaggggcagcaagatctatagatttaataacttatttctctgcagttggagcagaaaggtactgacctcctggtgatagcaatggaaaattatggctccttgggcagcaaaaagggtgtagaccttcctggtgactgtggacctgcttgccatgtcagaaaaggacatccaggatctgaagtttggggtagaatgggatgtggatatggtgtttgcctctttcatccatgtggcatctaatgtccatgaaattagaaaggcaattattgcaaactggagcaaggtgcccacttgcccaccagagttaggctcttaccttcccagaggaactgagacccacagctatttttatatatcttacagttcagatcagatacaaatatgtaaacctctacattatttctatgtagaaattatgatactctttaagcctgtcacagattttgttatttaatgcaaagaagcacatatattactatgggacacttttggtttgtttaaatattttgatagttgtattttaatgtaaagggtttcatttgtaatcttatacagatggtccccaacttacaatggttcaacttatgatttttcatctttacaacggcatgaaagcaatacattttcagtagaaactgtaggtcaaatactcatacaaccattctgtttttcactttactgcagtatttaataaacatatgagatattcaagattttaaaaaaaaaaaa

SEQ ID NO: 179 - DNA, 2505 bp, Homo sapiens
  CDS (212)..(2449)
aagtgatgtgggtaggacaggttgtgttagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 180 - DNA, 1964 bp, Homo sapiens
  CDS (465)..(1511)
actcaacatgcgctgctcgccgggaggcgtctggctggcgctggccgcgtcgctcctgcacgtgtccctgcaaggcgagttccagaggaagctttacaaggagctggtcaagaactacaatcccttggagaggcccgtggccaatgactcgcaaccactcaccgtctacttctccctgaacctcctgcagatcatggacgtggatgagaagaaccaagttttaaccaccaacatttggctgcaaatgtcttggacagatcactatttacagtggaatgtgtcagaatatccaggggtgaagactgttcgtttcccagatggccagatttggaaaccagacattcttctctataacagtgctgatgagcgctttgacgccacattccacactaacgtgttggtgaatccttctgggcattgccagtacctgcctccaggcatattcaagagttcctgctacatcgatgtacgctggtttccctttgatgtgcagcactgcaaacaagtttgggtcctggtcttacggaggctggtccttggatctgcagatgcaggaggcagatatcagtggctatatccccaatggagaatgggacctagtgggaatccccggcaagaggagtgaaaggttctatgagtgctgcaaagagccctaccctgatgtcaccttcacagtgaccatgcgccgcaggacactctactatggcctcaacctgctgatcccctgtgtgctcatctccgccctcgccctgctggtgttcctgcttcctgcagattccggggagaagatttccctggggataacagtcttactctctcttaccgtcttcatgctgctcgtggctgagatcatgcccgcaacatccgattcggtaccattgatagcccagtacttcgccagcaccatgatcatcgtgggcctctcggtggtggtgacggtgatcgtgctgcagtaccaccaccacgaccccgacgggggcaagatgcccaagtggaccagagtcatccttctgaactggtgcgcgtggttcctgcgaatgaagaggcccggggaggacaaggtgcgcccggcctgccagcacaagcagcggcgctgcagcctggccagtgtggagatgagcgccgtggcgccgccgcccgccagcaacgggaacctgctgtacatcggcttccgcggcctggacggcgtgcactgtgtcccgacccccgactctggggtagtgtgtggccgcatggcctgctcccccacgcacgatgagcacctcctgcacggtgggcaaccccccgagggggacccggacttggccaagatcctggaggaggtccgctacattgccaaccgcttccgctgccaggacgaaagcgaggcggtctgcagcgagtggaagttcgccgcctgtgtggtggaccgcctgtgcctcatggccttctcggtcttcaccatcatctgcaccatcggcatcctgatgtcggctcccaacttcgtggaggccgtgtccaaagactttgcgtaaccacgcctggttctgtacatgtggaaaactcacagatgggcaaggcctttggcttggcgagatttgggggtgctaatccaggacagcattacacgccacaactccagtgttcccttctggctgtcagtcgtgttgcttacggtttctttgttactttaggtagtagaatctcagcactttgtttcatattctcagatgggctgatagatatccttggcacatccgtaccatcggtcagcagggccactgagtagtcattttgcccattagcccactgcctggaaagcccttcggagagctccccatggctcctcaccaccgagacagttggttttgcatgtctgcatgaaggtctacctgaaaattcaacatttgctttttgcttgtgtacaaacccagattgaagctaaaataaaccagactcactaaatcctttccaaaaaaaaaaaa

SEQ ID NO: 181 - DNA, 2211 bp, Homo sapiens
  CDS (7)..(2106)
caaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcgtgggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaa

SEQ ID NO: 182 - DNA, 562 bp, Homo sapiens
  CDS (264)..(407)
tagttgtatatcattgtatatcatactcctcctattccttaatctggtaatgtattatcaatctgaaaattatcaagcataaagaatgttttaatgaagtaagaagtgttgtgatataatgaataaaagcccgtttggctttccttttaaatgtcattctaagtatgaattttgctcttggatttgaaagcagtgaaattacagagaaatggaagtaattctcttgtaaaaacacatcagagttacttctcagtttaaaagaaatgcatttattgttcttggcatatgtaagaatttgtattaaatatgtaataatcttgactttctttttaaaaatcaaaatcatgagtactttgtaccaactaaagcatttgttttatatcaaaattattaaaagaaatatattttaaacaagttaggtaaccttaatgtatattatgaggaaagtcataatcaaatcagaacttactatgttggaaattaacttgtgataaaaagaaaaaaatccaccctaaattgtattccctgatgggaagaatcttatctaggctaagtgacgaaa

SEQ ID NO: 183 - DNA, 760 bp, Homo sapiens
  CDS (44)..(583)
cgggtaagatggtgtatggagtaatgaagtctagtacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaatttccccatctggaagatgaagataatagtatctaactcacaaggttatcattggaataaatgaaagaacacatgtaatgcaaccagctggaattaagtgcttaataaatgttcttttcactgctttgcctcatcagaattaaaatagaaatatgtgactagtaaaaaaaataaaaaaaaaaaattcctcggtc

SEQ ID NO: 184 - DNA, 2081 bp, Homo sapiens
  CDS (28)..(1938)
cctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccagccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaatgaaagcggcagagaaagaagaaagacctagaaggttgtagatgggaaatcaggaatgatttgaactgataaagatttcagactcataagaacacat

SEQ ID NO: 185 - DNA, 630 bp, Homo sapiens
  CDS (349)..(540)
cctgtctcatcacctgtgaagcagacgcaagtttcttgaaagtatttttcaagcacgaacgtgcatgacgggtaaaatatctagaccgcatcactgcgcagccactagtcagtgcttcctaggagtcaagtttgtagtgtgaacttgatacatacggacacaagtttctgtcctgaagcttgcagtcactctgggaggtggtggatggtattactgggcccgtttttcattggggaaactgaggctccaacactgaaataattcacttcacctggagttgagccaagattctctttactccaaagccagcactccttctgagaacaggactttgatttggatggacggatgttgctgggggcctcagcacagggtctttgggctcacagctggacatgcagctgttcagcggcagctgcggtctgtccacccaggcggagactggatgcaacagtttcaggcggggttcctccctccccaggtgcctgcccacctctcccttacatgggatgtctctcttcttcctccttgcctggtccctaaagcacttgagtttgtggttcattttttaaaaaatgatatattttatttaacccagtatattaaaaatgtcatttcagaaaaaaaaaa

SEQ ID NO: 186 - DNA, 1225 bp, Homo sapiens
  CDS (57)..(914)
ggcctcgaacgggatggcagaggaggtgagcaccctgatagaaggccacggtcctgatgcggcagcctgggcgggtgcaggagatcgtgggcgccctccgcaagggcggcggagaccggttacaggtgatttctgattttgacatgaccttgagcaggtttgcatataatggaaagcgatgcccttcttcttacaatattctggataatagcaagatcatcagtgaggagtgtcggaaagagctcacagcgctccttcaccactattacccaattgagatcgacccacaccggaccgtcaaggagaagctacctcatatggtggaatggtggaccaaagcgcacaatctcctatgtcagcagaagattcagaagtttcagatagcccaggtggttagagagtccaatgcaatgctcagggagggatataagaccttcttcaacacactctaccataacaacattccccttttcatcttttctgcgggcattggtgatatcctggaagaaattatccgacagatgaaagtgttccaccccaacatccacatcgtgtctaactacatggattttaatgaagatggttttctccagggatttaagggccagctgatacacacatacaacaagaacagctctgtgtgtgagaactgtggttacttccagcaacttgagggcaaaaccaatgtcatcctgctgggagactctatcggggacctcaccatggccgatggggttcctggtgtgcagaacattctcaaaattggcttcctgaatgacaaggtggaggagcggcgggagcgctacatggactcctatgacatcgtgctggagaaagacgagactctggatgtggtcaacgggctactgcagcacatcctgtgccagggggtccagctggagatgcaaggcccctgaaggcgcaggctccagcccggcctgcaggccgtggtgaggaggggcgcctccccagagtctgctcccccgtgaacacagagcagaggccagggtggccagcagtggctgggtccttccgcgcccctccgtcctcctttccctgagcaccttcatcaccagaggcttgaaggaaccccgccatgtggcagggcacaggcactgttcctggtgaaccttggaccacagcatgtcagtgctctagggattgtctactccagggattttcttcaaaattgttaaacatgggaagttcaaacaaaaaaaaaaaa

SEQ ID NO: 187 - DNA, 2655 bp, Homo sapiens
  CDS (316)..(2001)
atggagaaatacggcacaaaaatgttaagtaatttgcgggctcttggctttgggcctcagtgcaagtccattggaaaaggcagctgcaacaatctagtggtcaccagcagtcccatgatggttcagcgactgggactcatttcacctccagcaagccaggtctctacagcatgcaaccagatcagtcctagcttacagagggcaatgaatgcagccaacctgaatatacctccttcagataccaggtcccttatttcgcgtgagtctttggcgtccacgaccttgagtctgacggaaagtcagtcggcctcaagcatgaagcaggagtggtcccagggctacagggccctcccttcgctctccaaccacggctctcagaatggccttgatctaggggatctccttagccttcctcccgggacatccatgtccagcaatagtgtctctaactcattaccatcctacctttttggcacggaaagtagccactctccttaccctagtcctcggcactcatccaccaggtcccactcggcccgctccaagaagagagcgctgtccttgtccccgctgtccgatggcatcgggatagatttcaataccatcatccgcacgtcgcccacgtccttggtggcctacatcaacgggtcgagggcttcgccggccaacctgtccccgcagccggaggtctacgggcatttcctgggcgtgcgcggcagctgcattccccagccgcgcccggtgcccggcagccagaagggcgtgctggtggcccctggaggcctggcgctgccggcctacggcgaggacggggccctggagcacgagcgcatgcaacagctggagcacggcggcctgcagccaggcctggtcaaccacatggtggtgcagcatggcctgccgggccccgacagccagtcggccggcctgttcaagaccgaacgcctggaggagttcccgggcagcaccgtagacctaccccccgcgcctccgctccctcctctgccgccgcccccaggccccccacccccttaccatgcccatgcgcaccttcaccacccggagctcgggccccacgcccagcagctggccttgccccaggccaccctggacgacgacggggagatggacggcatcgggggcaagcattgctgccgctggatcgactgcagcgccctgtacgaccagcaggaggagctcgtgcggcacatcgagaaggtccacatcgaccagcgcaaaggggaggacttcacttgcttctgggccggttgccctcgaagatacaagcccttcaacgcccgctataaactgctgatccacatgagagtccactctggggagaagcccaacaagtgtacgtttgaaggttgcgagaaggccttttcaaggcttgaaaatctcaagatccacttgcggagccacacaggcgagaagccgtatttgtgccagcatccgggttgtcagaaggccttcagtaactccagtgaccgcgccaaacaccagcggacgcatctggacactaaaccttatgcttgtcaaattccaggatgtaccaaacgctacacagacccaagttccctaagaaagcatgtgaaggcacattctcccaaagagcaacaagcaaggaaaaagttgcggtccagcacagagctccatccaaacctgctcacagattgcctcaccgtgcagtccctgcagccggccacttcccctaaaaatgctgctgctgaagggaccgtgggacgctcccctggacccggccctgacctctattcagctcccattttctccagcaattattcaagccgaagtggaacagctgctggggccgtaccacccccacatcctgtcagtcacccttctccaggacataatgtacaggggagccctcacaacccctcctcccagttacctccactcacagctgtggacgcaggagctgagagaggtcaggcccgggtccaggggagcgtcccacggtcccttcagcagcagcatctctaggggaagtggccggctgcagggactgcacggtgaggcaatctgtgagcaggtctggatggagctctgtgctggaccgcaactaagaggacaaaacggaagagacatcgataaggagagccggtccttggaatattttcctgggaaggcatcatgctctatcagtgcaactcagcccacaaaaatttatcaagcagcaactacgggtcctctgaacgggccacaccacggttgagccattgtgacccctgcgacacacaggtccaggcctcctggagtcacaaagctttgagcaacaggagaaccactaaagaagaagaaacagctagctcctgccttaactgattaaccgaacttgcaacattccaccattgtgatatgttcctgccctaccctaaataatcaatcggccttgtgatatcctgccatgtgaactccctccacctcgtgactatgcaccttgtgacattcttcccctgcccgaaaagactgccccaactgtaaccttccactacctaatccaaactataaaaccagtccactcccacggccttcgctgactcctttcagactcagccgtcgccggagtgataacagcctgtgtcccaaaaaaaaaaaccgggtttgtggggcggaagtgagccggctggtcgc

SEQ ID NO: 188 - DNA, 1120 bp, Homo sapiens
  CDS (110)..(1030)
ctgtctttgcgttttggtgtgctgttggtgctcctgtattgctggtgtttattgttcagtcccgtgtagtattgatgttgacggaagatgaagaattataaagcataagatgaaaaagattgcacaatattgccgcgtactacaggaaggtcctggtttgtcccttattaggtttacattgcgccgtttctcaatgtgggaggtctccttatgtcgtcagcgagcccatttggggcccagtgagttccagatggaccggaacttcataaggataggatgcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtaaaaaaaaaaaa

SEQ ID NO: 189 - DNA, 705 bp, Homo sapiens
  CDS (53)..(544)
tttcgtggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaaaaaaaaaaaa

SEQ ID NO: 190 - DNA, 432 bp, Homo sapiens
  CDS (10)..(216)
tttcgtgccatgttggggtttgtgggtcgggtggccgctgctccggcctccggggccttgcggagactcaccccttcagcgtcgctgcccccagctcagctcttactgcgggccgctccgacggcggtccatcctggtaagtgcttttctctaggagctaacgttccattttgccgccccatgaccttgagccggggaacgatggtagctcgggcctaagggatccgtggtgttaaaaggatgcctggagccgcgtcttgctctctaatggctggagaacaagaatgggacacccataggaggtttcttcgacccagctctgtcccattttgtataaagtcctttgtgtgacggaaaaggtgcgggcaggtgcgttgaccttccggttgaataggggtactgaactctcgaaaaatggggtcttgtgcatgc

SEQ ID NO: 191 - DNA, 961 bp, Homo sapiens
  CDS (5)..(553)
cgccatgttggggtttgtgggtcgggtggccgctgctccggcctccggggccttgcggagactcaccccttcagcgtcgctgcccccagctcagctcttactgcgggccgctccgacggcggtccatcctggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattgggctttttggtggtgctggagttggcaagactgtactgatcatggagttaatcaacaatgtcgccaaagcccatggtggttactctgtgtttgctggtgttggtgagaggacccgtgaacggcaatgatttatacccatgaaatgattgaatctggtgttatcaacttaaaagatgccacctctaaggtagcgctggtatatggtcaaatgaatgaaccacctggtgctcgtgcccgggtagctctgactgggctgacctgtgtgtgatacttcagagaccaaggacggtcaagatggtactggtaattatgataccatccttcgcttaccagggtggtcagaggtgtctgcttattggcgatccttcctgtgggggataagctacctgggcctgactgggctatgccggaagattcccacagaggttcccctcgaggattatgcccaaaatgctgcccccgtatgtgccttctcatgatcgctccctgcgcaccggccttaactctagcacttggaaacggggatcaccatg

SEQ ID NO: 192 - DNA, 1083 bp, Homo sapiens
  CDS (53)..(844)
tttcgtggcggctgcggttgctgcagccttcagtctccacccggactacgccatgttggggtttgtgggtcgggtggccgctgctccggcctccggggccttgcggagactcaccccttcagcgtcgctgcccccagctcagctcttactgcgggccgctccgacggcggtccatcctgtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacaatttgctcccattcatgctgaggctccagagttcatggaaatgagtgttgagcaggaaattctggtgactggtatcaaggttgtcgatctgctagctccctatgccaagggtggcaaaattggggcttttggtggtgctggagttggcaagactgtactgatcatggagttaatcaacaatgtcgcccaaagcccatgggtggttactctgtgtttgctggtgttgggtgagaggacccggacggccatgatttataccatgacatgcttggatcctggtgttttccatcttaaaagatggcactcctaatgtagcgccgggttttgtcccatgtaattaacccccggtggtcctgccggtagcctacatgggcggacgtggcgaaaaaacttcgcagaacccaaggtcccagtttggcgttttttggaaaacttttcgtccccgccgggggcgaaagtgtgccttggggcgccccctcgtggggaacaccccgccgactgtgtgttgcgagaaacacacagaggacatcccggctttgttatgaa

SEQ ID NO: 193 - DNA, 2568 bp, Homo sapiens
  CDS (4)..(2442)
cagatgaagagcttggccggtttcgagtcgctggcctgcagcttccctgtggtttcccgaggcctccttgcttcccgctctccgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaaaaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaaccgtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcaagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcacgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatc

SEQ ID NO: 194 - DNA, 361 bp, Homo sapiens
  CDS (83)..(310)
gctggcctgcagcttccctgtggtttcccgaggcctccttgcttcccgctctccgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagatttgaaagaagataaacctaggaaaaggttggttaatgatgcaggaaacaagaagaattcaat

SEQ ID NO: 195 - DNA, 2188 bp, Homo sapiens
  CDS (539)..(958)
caattttttttttttttttttttttcttatggtaatccaaacggtatccatagcgtttacggtgtaattcaatatattcattctgtggcatggtgacggccgcagagccgccaggagcagccgctggagtgcgaaaacgctctcaattttcgggtctcaaagacccacaagcccacaccacgcaggccgggacaggaaagagtcaccctttaaaacggccgagtgaagagcaagaaccacgcagcggttccgagcctctgttttccgcttttagctaggaggacggaagttgctggcaggcggcatttggccggtacaccgccggaagtgtggaggtgtggctgcccgaggcggtagagcggagaaagcctattttcttttcgtttagatacattgccttttgcctaggctggcgtcgagacttgaggccgttgcagactttggcgcggctcgcgcctcctgcttcaagagcccagcggtgagagctggcctgcggcacgcggcctaatgccagacagtaacagtttggaggatcaagatgttgaccaacttgaggatatttgcaatgagtcatcagacaatacccagtgtgtatattaataatatatgctgctataaaataagagcaagtttaaaaagattaaagccacatgtgccgcttggaagaaattgcagttctctaccaggcttaataggaaatgatatcaaatcccttcattccatcatcaatcctcccatagctaaaatccgtaatattggaattatggctcatattgatgcaggcaaaactaccaccacagaaagaatattgtactattccggatatacaagatcactgggagatgttgatgatggagacacagtgacagatttcatggcccaagagcgagaaagaggcattactattcaatcagctgctgttacatttgattggaaaggttatagagtcaatctaatttgatacaccaggtcatgtggactttaccttggaggttgaagcggtgcctaagagtgttggatggtgcagtggctgtatttgatgcctctggctggtgtagaaggccagactctcacagtatggaggcaagctgataaacacaatatacctcgaatctgttttttaaacaagatggacaaaactggagcaagctttaagtatgcagttgaaagcatcagagagaagttaaaggcaaagcctttgcttttacagttaccaattggtgaagccaaaactttcaaaggagtggtggatgtagtaatgaaagaaaaacttctttggaattgcaattcaaatgatggaaaagactttgagagaaagcccctcttggaaatgaatgatcctgaattgctgaaggaaacaactgaagcaaggaatgccttaattgaacaagttgcagatttggatgatgaatttgctgacttggttttagaagaatttagtgagaattttgatttgttaccagctgaaaagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgcagtggtataaggatgacttatgtgcattggcatttaaagttctccatgacaagcagcgaggaccactggtttttatgcgcatttactcaggcactataaaaccccagttggccattcataatattaatggaaactgcacggagagaataagtcgtctgcttttgccgtttgctgaccaacatgtagaaatcccttcattgactgctggtaacattgctttgactgttgggcttaaacatactgccactggagacaccattgtctcatccaagtccagtgcattagctgcagctcgtagagccgaacgggagggagaaaagaagcacagacaaaacaatgaagcagagagacttttattggctggagtggagattccagaacctgttttcttctgtaccatagaacccccatcactgtctaagcagccaggtataaatggtcttagtgtgtcaactaattagtgcgctgataatttatataaaatagttgcaatataccctcaagagatttcttatgtgattgaggtaaattttatctgaatatattggtaaacattaaaaaaaaaa

SEQ ID NO: 196 - DNA, 917 bp, Homo sapiens
  CDS (174)..(335)
tgcgcgcagcggtacggaattcccaggccgagcgattacgattttgctcagattggtgagggaagagcctgcctgtggggagcggccactccatactgctgaggcctcaggactgctgctcagcttgcccgttacctgaagaggcggcggagccgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatgtgagcagcggcacacgggtccgggcagggggcaagggctaaggaaggagtggctagggcaggggcgggaaccggggtgcttgaccacacgtgaagactcagaactaacccaggcagcctggaactcggagaggtgatgagcagaacttactcgcattggggaaaggatgggtagggacccttgggtatatctgggactctggcagtggtgctttcctccctccgcccccctcaccacttaccagaataaaaaaccgggaatgagaagaccactttgggttactgtaacacctgcactagtgagtgaccacgccccctttcctcttccccctcgcccccttgctgctgggccacagcccagaatcccagggagtgatcagcggtgctgttttccttatcatcctcttctgcttcatccctttccccttcctgaactgctttgtgaaggagcagtgtaaggcattcccccaccatgaagtaagtgggttcgtgggggtgattgcctgtggctgggacctgggaggtacctgagagaactggggttatttgggcttgtggggaggggctaagaaattatcagaaa

SEQ ID NO: 197 - DNA, 817 bp, Homo sapiens
  CDS (104)..(601)
cgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcatcgttgtaaagtgccatcagacaagatcagttgatcagaacagaaagctagctcggaaaatcctacaagagaaagtagatgttttctacaatggtgaaaacagtcctgttcacaaagaaaaacgagaagcggcgaagaaaaaacaagaaaggaaaaaaagagcaaaggaaaccctggaaaaaaagaagctacttaaagaactgtgggagtcaagtaaaaaggtccactgagaaaagaattagagattccaactgacagaatctgccagaagctcccagggaataatggtggcgagttccatcaccagcattattatagtgcttcaaaagaaatatttttgatgaacttaaaagacaacaaatttatttaaatggtgcactaaactgtagtgaacagagacatgcacgattcaagaataaaactcggccgggcacggtggacgg

SEQ ID NO: 198 - DNA, 1056 bp, Homo sapiens
  CDS (103)..(459)
gattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagaatgaactcgaagagcagtttgtgaaaggacacggtccagggggccaggcaaccaacaaaaccagcaactgcgtggtgctgaagcacatcccctcaggcattgttgtaaaggtagatcacagaaggccgctgaggggagaggccccgcccaagggttccacagcctccagagatttctcccaagtgtgaatgggatcagccgaagtgcattatttttctggcttgggccaccctctaccagccaggcagtagagagcaccgcagatctcgtcccatccctgagccgttcctccctaaggcagaacctcctacaacagcctgggaagcctgtttccaggatcttttggagccagggtatggctgccatccttgaatttggcagacagcactggtgcttggctgctgccccggaagcaacgtcttgacaaagctaagcagtggctgataaaggcaggcgcccgggcagtatggttctttcaaatctgttcccactgcaggaaggctgccgagatccccagcattgctatgggatccaagtccctgaggaggcggcaagcaggcatgggttgtctgctggcagtcccagcccttaactgtcatggctggttaacattagggtggccacatcctccacgcctctctgtcccctttggtaaatgtcggtgatacctcctcttctggacagagaggactgagggcgagatcatggaggatcatggaggccaggcattttccaacctcagaagaaaaaatgctgtgcacagctgcctataggagtcttcc

SEQ ID NO: 199 - DNA, 1168 bp, Homo sapiens
  CDS (91)..(918)
ccagcttctccagggccaagctgttgggggtgaggtgcagcccgaagcagccagaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgtaagttgcactcaggagggtttaggggagggccatgggcag

SEQ ID NO: 200 - DNA, 796 bp, Homo sapiens
  CDS (145)..(546)
atatttatcccccccccccggtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagctgagtgagcctccgccatccagcatgacaaactgtggccgaccgcagctgtgccgtggcacgatggcgaggaagccagccccaaggaaacactgaaaacacatatcacgccaatgccgtgtggttttgtttgaatataaaattggtgaaagtgttggtttttttaaggcagtaatttttttgtttgtttttttgcgatttcattccattcttgaccaaagcttctctttaagtagtttattatggaaaattgtcacactaacttaaaagacagggtgagggagatatgtaaattgtccactagaaaattaaataaaagaactgaatgtgaaaaaaaaaaaaa

SEQ ID NO: 201 - DNA, 3398 bp, Homo sapiens
  CDS (174)..(2234)
gctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaaacaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatccaagaatttaggaaattaatgtggacactataaaggcagacttagggccaactttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttggtccttaaatacctaccatgtatgaagctatacacagcatataccgaaagaacctgcattgcactaggaattctgtgttagtttaaaagagatctctaaaacttccccatccctttgggcctgtacaaa

SEQ ID NO: 202 - DNA, 752 bp, Homo sapiens
  CDS (105)..(530)
aggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggccacggcccgcttgtctcaaccaccgcagcctttgctgcaggtaaggactctggactggactggggcatcgcgagccagcgaattcctgccgaggagctgagccatctctcttgtccttgtccccagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcctacatctgcccgcccttccagcccttccccagcccctcaacttgtttcttcattcattcaacaaaatttaactggaaaaaaaaaaaaaa

SEQ ID NO: 203 - DNA, 1183 bp, Homo sapiens
  CDS (136)..(645)
tcatttagttgtccaaaggccagtgggtcccagagcatataaagctgcaagctggctaatgagctcattctcttggagcaagcagggaagcagaggagcagcagggtcagggtgctgggttcctaaggtgcaaggatgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacaggccagacttttaccctccagcttatgaagagagccttgaggtggaaaagcagagctgtcctgcagagagagaggcctctggcattcctccacctctatatacagagacgggcctggaattccaggatggaaatgactcccacccagaggccccaccatcttatagagagtccatagccggcctggtggtgacagcaatctcagaggacgcccagaggcgaggccaagagtgctgaggcagagaaagctctccagcactcatgatgccaccactgtggggagcagctactgataataaaggcaaacgagggactgtgggaggaaaagccacaccagtgaccccacaagagagcttggggaggggatgacagccctgaattccagacgtaactggccatgccagggcagggcaggccaaggggccctggaagggtgtggccaacaccaagcagacatttcagaggattcacactaatcttaaccccggctggccttgggtccccaaaggtgtcactctgagagctctgcttacagagattctttctgctgtcactcaatttccctcccatcacctcaactccagccagggaggaatagatgctggttgtcaggacagccacatgccttcctgttctatatcacctagtaatctcaaagcgaaggtttgttgtttaatttattgattgttcagccttttgttttgctagcttgtttcctatttacctccagctgaccatactaccagagtgaggcagtacttcacatcctgcg

SEQ ID NO: 204 - DNA, 1154 bp, Homo sapiens
  CDS (409)..(768)
gatgacggtaattacctgaaaccacctctgagggaaggtggtggcgtctcaaatgcatgggcatgtggctggtcaggtggcctccatcccagggtgccccgtctgtgtgacctccctctgggtgctgtgggcttgctccagggtgcaggtgcaaccccagcagcggtctctggggccaggcaggtgggtggacgattggacttggaggggaatacagagggcatggaagtggcgaggctggcctgttggcgagggtgtcctggtggtggggcgggctgagtcagggaaggactctgaaggtcccaagcagctgctgaggcccccaaggaagtggttccaaccttggacccctaggggtctggatttgctggttaacaagataacctgagggcaggaccccataggggaatgctacctcctgcccttccacctgccctggtgttcacggtggcctggtccctccttgccgagagagtgtcctgggtcagggacgcagaggacgctcacagactccagccctttgttaccgagaggacacttggcaaggtccagcgatggtccggagtccacacacagactggcggcagggcaggagggggacagttctgttgtgcttggttggacagtaagagggtcttggccagtccagggtggggggcggcaaactccataaagaaccagagggtctgggccccggccacagagtcatctgcccagctcctctgctgctggccagtgggagtggcacgaggtggggctttgtgccagtaaaaccacaggctggatttgcctgcgggccatggtccctgtctagggcagcaattctcaaccttcttgctctcaggaccccaaagagctttcattgtatctattgatttttaccacattacctgataccaaaaggttagacacacgttacaagaaaagaaaactacagataagtattctcttgaacacaggtacaaaaatgctaaatagaatttttgcaaattaaattcaatgctatataaaaacaaaacatgatctagtgggatttatttcagggatgcaaacctgtttaaggattgaaaaatcaatggatgcctcttcagattattaaagaattatttttaaagagagaaaagtccatgtaatttaccatattaaaaaaaaaa

SEQ ID NO: 205 - DNA, 1584 bp, Homo sapiens
  CDS (51)..(1166)
tttcgtggcagcatccaggcgctggtcgccttcggggtgcgggggaggacatgctgctgctgaagaaacacacggaggacatcagcagcgtctacgagatccgcgagaggctcggctcggggccctccccgctccactctctctccctcctgcctctcctctcttcccacttccttcccacctcccaccgccccgtctgcggcaggggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaaaaa

SEQ ID NO: 206 - DNA, 768 bp, Homo sapiens
  CDS (362)..(694)
tcaggacagcccagtgttagaatagagtggcggaggtaccaagaaaggattcctgctatccagaaataattccactattctattccagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagag

SEQ ID NO: 207 - DNA, 1260 bp, Homo sapiens
  CDS (8)..(766)
ggggaccatggaggccgcaaggcccttcgcccgggagtggagggcccagtccctacccctggcagtagggggcgttttgaagctgcggctctgtgagctgtggctactgctactgggttctaatttgaacgccatatttttgccagacgaggaggacgtaaactttatcaacgagtacgtgaacctccacaatgagctgcggggcgacgtcattccccgagggtctaacttgcgcttcatgacttgggatgtagctttatcacggactgctagagcatggggaaaaaaatgtttgtttacgcataatatttatttacaagatgtacaaatggtccatcctaaattttatggtattggtgaaaatatgtgggtcggccctgaaaatgaatttactgcaagtattgctatcagaagttggcatgcagagaagaaaatgtacaattttgaaaatggcagttgctctggagactgttctaattatattcagcttgtttgggaccactcttacaaagttggttgtgctgttactccatgttcaaaaattggacatattatacatgcagcaattttcatatgcaactatgcgccaggaggaacactgacgagaagaccttatgaaccaggaatattttgtactcgatgtggcagacgtgacaaatgcacagattttctatgcagtaagataaagaaaataaacatgaaaaaaatgcataatggattggacaagaaaaataagcgattgaacactagttttttatggtcatgttaatattattcctttgatcagaatgctactattatgttatcaaaggatggttgacacagtatcatctttagatttttctaaactgcagagctttttctgttctatcttaaccctattccttcccctgaggacataccagagtgtcagaaagaaagaatgagaactaacagttatacccttaaaaagcttcacagtttatgcccaaacagcagcctgtttgataataactgctttaaaggatagtatattccaaaatatttatgaagtagcatatatttaatacccttttcttttagtttttcctccaaaaagctgaaatctccaaatatttcaaaagtaaaaagtagaaaatatgtttgattacatttttcttttagtttttccaaacatgagagaatatactccaaaagtataactgtagctaaaatatacaatgcttagaggaatatggtaggagataaatttggataataagtaaatagcatattatgttg

SEQ ID NO: 208 - DNA, 638 bp, Homo sapiens
  CDS (203)..(496)
gctgcagttttcctcagcttgggtggtggccgctgccggggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaaggtgctgtaaaatacctggagtgctcggcgcctcccgtgaagaagaggaagagaaaatgcctgctgttgtaaatgtctcagcccctcgttcttggtcctgtcccttggaacctttgtacgctttgctcaaaaaaaaacaaaaaaaaaaa

SEQ ID NO: 209 - DNA, 1261 bp, Homo sapiens
  CDS (109)..(996)
atgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacaggtgaatttaaaatgtgctcctcgtgtttggtttgtgagtctaaaggaaacatggattttatttctcaggaacaaacatcaaaagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctggagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaa

SEQ ID NO: 210 - DNA, 1177 bp, Homo sapiens
  CDS (109)..(912)
atgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctggagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaa

SEQ ID NO: 211 - DNA, 2385 bp, Homo sapiens
  CDS (94)..(1506)
tgtcggctcggttcggtcgcgttacagggcaggcgccggggccaaggcagggagggatcttaggagagatcgtaggacatctgaagagctgccatgtctggggcatcttcctcagaacagaacaacaacagctatgaaaccaaaaccccaaatcttcgaatgtcagagaagaaatgttcatgggcctcctacatgaccaactccccgactctgatcgttatgattggtttgccagcccggggtaaaacctacgtgtccaagaaactaacacgctacctcaactggattggagtccccaccaaagtgtttaatcttggggtgtatcggcgtgaagcagtcaagtcctataagtcctacgacttctttcggcatgacaatgaggaggccatgaagatccgcaaacagtgtgctctggtggcgctggaagatgttaaggcgtatctcactgaggagaatggtcagattgcggtgtttgatgccaccaatacaacccgggagaggagggacatgattttgaactttgctgaacagaattccttcaaggtattctttgtggaatccgtctgtgatgatcctgatgtcattgctgccaatattctggaggttaaggtatcaagccctgactatcctgaaaggaacagagagaacgtgatggaggacttcctgaagagaattgaatgctacaaagttacctaccgacctcttgacccagacaactatgacaaggatctttctttcatcaaggtgataaacgtgggccagcgatttttagtcaacagagtccaggactacatccagagcaagatagtctactacctcatgaatatccacgtccagcctcgcaccatttacctttgccggcatggagaaagcgagttcaatctcttggggaagattgggggtgactctggcctctcggtgcggggaaagcagtttgcccaagctctaaggaaatttctggaggaacaggaaataacagacctcaaagtgtggacaagccagttgaagaggaccatacagactgctgaatctctcggggtgccctatgagcagtggaagattctgaatgagattgatgctggtgtgtgtgaagagatgacctatgcagagattgagaaacggtacccagaagagtttgcacttcgagatcaagagaagtatctgtatcgatatcctggtggggagtcataccaggacctggtgcagcggctggagcctgtcatcatggagctggaacgtcagggcaatgtcctcgtcatctcccaccaggctgtcatgcgctgcctcctggcctacttcttggataagggcgcagatgagctaccatacttgagatgccctctccataccatcttcaaacttactcctgtggcctatgggtgcaaagtggaaacaattaaacttaacgtggaggctgtgaacacgcaccgtgacaagccaactgcagcagagaccacactggctgtgcgcagacgcccctccgcagcgtccctcatgttgccttgctaatgatgtggatgttcaggcctcacctctccaaacgactgggatctactgaaaagcttgggatgtcagcttcacagaggctagaacaggaagttaagtgggaactggactttgggggccaccaaaacgaggcctggagaaacgtcaccatatttcctcccctcctgcctaatgggaatatcagttacactgaaaaatttaacttccctgtgcctcaaaacatttagcaacctgaaccagtgactttttgtcatctctgtgctgagtttggtccaagttggtcaatctcattctgtataggcatttaacatcctacctgtgactgtctgcatcctttgctggctcttttttgcccaaagtgcaaatgcacttcttcagatttacttttcaagtgagaaggtaagagctggtctctgccactgttccaggcgagcaggctagagtctaatatacttatgctagcagttaccatttgccacattggaagcaagagacaaatcaccaggtgaatggagggtcttctgagaaattcagtccctaaaacatcttctctgccttgatagaagaacagtgtcagtggcaaccttttcatttagagaagtttttcttgtcccaggcccttcaggacaggatctgactgcaagactccccaaaatgggtacccatcttttaaggtcccttttgtagctactgtacttttgacttgatgcatgtgcctctcatgcattaagatggggctgatgtggttctctctggtgggttttgaatgtgtactataccgaaatgtatagggccttttatttctcggggtatgtatagaaagctccttttttaaacagcccgatcagggagtgttttggcttatatctgtagtaaatg

SEQ ID NO: 212 - DNA, 2546 bp, Homo sapiens
  CDS (112)..(1854)
aaaaaaacaaaaaacaaaagaaagtgtaatgcatgaagtgaaatgaaaaatagatgctgggaaggatgtctaactgggagatagcttgtgatgtaaatatgtaaatatattatgaatgaccagtgggcaaggcaaaattgcctacacagccctacctatggcccctctgaaaatgttctttcttcagcagaatcgaagccagaaattcaacttagtccctcctgccctctgattttctccagtcagcaagctctcagccaacatgtgtggctgagtcatctctctcagctgttttcaagtttatgggcaggaaatcctctccacctgggaaaacactatccagaagatcagaaacaacagcaggatccattctgctttagtggcaaagcagaatggattcaagagggagaagactccagactcctgtttgggagagtaagcaaaaatggcacttcaaaggcactttccagcccacctgaagaacaacagccagcacagtccaaggaagacaacacagtggtggatatagggtccagccctgaacggagggcagatctagaggaaacagacaaagtattgcatggtttagaagtctcaggatttggagaaatcaaatatgaagagtttgggccaggctttatcaaggagtcaaacctccttagcctccagaagacacaaactggggagacaccttacatgtacactgagtggggagacagctttggcagtatgtcagtcctcatcaaaaacccaaggacacactctgggggaaagccttatgtgtgcagggaatgtgggcgaggctttacgtggaagtcaaacctgatcacacatcagaggacacactcaggggagaaaccttatgtgtgcaaggattgtggacgaggctttacttggaagtcgaacctctttacacatcagcggacacactcagggctcaagccttatgtgtgcaaggaatgtgggcagagctttagcctgaagtcaaacctcattacccaccagagggcgcacactggggagaagccttatgtttgcagggaatgtgggcgtggctttcgccagcattcacacctggtcagacacaagaggacacattcaggagagaagccttacatttgcagggagtgtgagcaaggctttagccagaagtcacacctcatcagacacttaaggacacacacaggagagaagccttatgtatgcacagaatgtgggcgtcactttagctggaaatcaaacctcaaaacacaccagaggacacactcaggggttaaaccttatgtctgcctggagtgcgggcagtgctttagcctgaagtcaaaccttaacaaacaccagaggtcacacacgggggagaagccatttgtatgtacggagtgtgggcgaggctttacccggaaatcaaccctgagcacgcaccagaggacacactcaggggagaagccatttgtatgtgctgagtgtggacgaggctttaatgataagtccaccctcatttcacaccagaggacacattcaggggaaaagccttttatgtgcagggagtgtggcagaaggtttcggcagaagcctaacctgtttaggcacaagagggcacactcaggtgcctttgtgtgcagggagtgtgggcaaggcttttgtgctaagttaactctcattaaacaccagagagcacacgcaggggggaagcctcatgtgtgcagggagtgtgggcaaggctttagccggcagtcacacctcattagacaccagaggacacattcaggagagaagccttatatttgcagaaagtgtggacggggctttagtcggaagtccaaccttatcagacatcagaggacacactcaggatagaaactttatgtgtatagggaatgtggtacagcctttagccaggagtcatacttcatcagacaccagaggacacacacagtgctgtggctttttcagccattgctagataccaaagtggagacattctgtgtgtgattatgcatgagactgtactggtaagacttgtatctccatccacctgaaggagaattgctggctcattttcaggagccctgcccttcctcactgtggatggtgggttgtggaaacccggtcaggtaatgatagtggcaggaggcagtcaaatgcccaggcagataggggtgggtacctggtgaaacccaaccttaaagctgaagacagtcccggctaaatcctcatactgaattgagaacctgtcttcccatttggtgtgctttcctccgattgatcccaacccttcacctattttacgtatacctgccctttcctaattggtttttacactgctgtgcccaccttttgagtggtgcctttgcatacttacaaatcagtcaacgtgtattcccctattttgagcccataaaagacccagactcagctgcagtgaggagagaaatcaccctgctgtgggggttggggaccactccctgcatcccctctccactgagagctgttcttttgctcaataaaattcttttctacccatcctcacccttcaaaaaaaaaaa

SEQ ID NO: 213 - DNA, 1607 bp, Homo sapiens
  CDS (136)..(1065)
ttctccgattaacgtctgagattcacaggactgtctagctctgagtcctagcaatagactccttagaggagtagtacgtttatctagattttctctagataatgcaggcggaagacctgggttcccgggtggggcatgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctaaaaaaaaaa

SEQ ID NO: 214 - DNA, 2480 bp, Homo sapiens
  CDS (626)..(2113)
ggcccgcagggggtagcagagccgagcccaccccgccctctcccgcccgggtccgcgcaccgttccgctgcagaaagcgcaggccatcccggtatccctgcttgcacatctctcgcagcaccaggggctccggcgggaagagggccttggagaggcggtagaggttgcgcaggttgaactggatgctggtgttggtgacccgcagctcgtggatgttggtggagctgtcctgcggacagatgtcactctcgcccgagaagggggacactgtgatggtgttcttaagctcatagagtggcaggttgtctgaaatgccaccatccacgtagcgcttccacgggacacacagacaggaccgtatgtgagggcctgtggctgcactggccacccaccccagccaccccacccggccaccaagggccccattcagtggctacctcatttgagcgttttacccactgggcactggctgtgggccagcctgggcactgagcagatggtagacgggggagggcagggacggaggaagggatggggggccaggaagcgtgcgttgccacagctgtttcttgagtaacacagggggaagtgggtaacaggcggtggcagagcaagggcctgaaggatggctctaggcggcctcctcctctgtccctcatcccacggcccaccccatagaaggtgtccagggctaggaatactcaccaccccctggagggagggagggatgagcccacagtacacggggatgaaaccgctgcagacattggcctggatgagctcgtccttggagttgaagtgggatataatgacattctcgccgtctgacacgcgggtcagggagatgcccaggcgcccctccttcaacctggtaaagatcatccgcagtttcctgctgaaggtcgtgcctgctgatagccatgagcatgccagtgggcgcctgggcatctccctgacccgcgtgtcagacggcgagaatgtcattatatcccacttcaactccaaggacgagctcatccaggccaatgtctgcagcggtttcatccccgtgtactgtgggctcatccctccctccctccagggggtgcgctacgtggatggtggcatttcagacaacctgccactctatgagcttaagaacaccatcacagtgtcccccttctcgggcgagagtgacatctgtccgcaggacagctccaccaacatccacgagctgcgggtcaccaacaccagcatccagttcaacctgcgcaacctctaccgcctctccaaggccctcttcccgccggagcccctggtgctgcgagagatgtgcaagcagggataccgggatggcctgcgctttctgcagcggaacggcctcctgaaccggcccaaccccttgctggcgttgccccccgcccgcccccacggcccagaggacaaggaccaggcagtggagagcgcccaagcggaggattactcgcagctgcccggagaagatcacatcctggagcacctgcccgcccggctcaatgaggccctgctggaggcctgcgtggagcccacggacctgctgaccaccctctccaacatgctgcctgtgcgtctggccacggccatgatggtgccctacacgctgccgctggagagcgctctgtccttcaccatccgcttgctggagtggctgcccgacgttcccgaggacatccggtggatgaaggagcagacgtgcagcatctgccagtacctggtaatgcgcgccaagaggaagctgggcaggcacctgccctccaggctgccggagcaggtggagctgcgccgcgtccagtcgctgccgtccgtgccgctgtcctgcgccgcctacagagaggcactgcccggctggatgcgcaacaacctctcgctgggggacgcgctggccaagtgggaggagtgccagcgccagctgctgctcggcctcttctgcaccaacgtggccttcccgcccgaagctctgcgcatgcgcgcacccgccgacccggctcccgcccccgcggacccagcatccccgcagcaccagccggccgggcctgcccccttgctgagcacccctgctcccgaggcccggcccgtgatcggggccctggggctgtgagaccccgaccctctcgaggaaccctgcctgagacgcctccattaccactgcgcagtgagatgaggggactcacagttgccaagaggggtctttgccgtgggccccctcgccagccactcaccagctgcactgagaggggaggtttccacacccctcccctgggccgctgaggccccgcgcacctgtgccttaatcttccctcccctgtgctgcccgagcacctcccccgcccctttactcctgggaactttgcagctgcccttccctccccgtttttcatggcctgctgaaatatgtgtgtgaagaattatttattttcgccaaagcacatgtaataaatgctgcagcccaaaaaaaaaaaaaa

SEQ ID NO: 215 - DNA, 2501 bp, Homo sapiens
  CDS (106)..(1989)
tttcgtgtggctccccgtcctggtgcgggacctgtgccccgcgcttcatccctccccgcacagcctattgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggtctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgcccccctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctgctcctccatcgcaaaggcatcctcaaactcaatggcaagttctcccagacagccttggagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacctgagtggagtaggcattgccccagcccggtcaggctctcagatgcagctggttgcaccccgaggggagatgccttactccccacacctcccaggagctgcatcccagctcagaaggctgagagggtttgcagtggagccctgagcagggctggcatatggcaagtaggcaaatgacatgcgccaagggtacaggtctgtcttacagacctgctgaacgaagaggatactaacgagccggggaacggaaatgcccgcgacagagtcacatggcctgttccttgtgtactgcggggccccgagacctggaaagagaaacttccaggggcattccggatccattaatttcgtacctgggctctaggaagtcttcctatcattccggccagggcgactttaacacattcgtttacaacccgaatggtgggccctggtagctcggagggggacgcggatttttaccaattacaggctcggcgcaagggagccccccggatccactgagccgcgcaca

SEQ ID NO: 216 - DNA, 2769 bp, Homo sapiens
  CDS (429)..(2141)
ccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctgggggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaagaccagagtaatgcggagaagcacgcagatggaatgataagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggaaaaaaaaaaaaaaaaa

SEQ ID NO: 217 - DNA, 1022 bp, Homo sapiens
  CDS (627)..(1019)
aaggatccttaattaaattaatccccccccccgggtctgcatctccatcggaaagtgcgcttgccacatcccttcggatcacttcgtcctcccgagagcgttctgccttctacagctcggaaagaaagaaatcttagctgtgaagtgaccgtggagaaagcgcaggaagcgacacaattggttagggaggcagagagtgtgagcgggcgcaccccttgcctggggaccgcgctcgcgggcggggacggagcatcccagtggctgcacccgccgctccgcgctcctgcctggcgtcgccaaccccgcggcggccgctggaattccagagctgccaggcgctcccagccggtctcggcaaacttttccccagcccacgtgctaaccaagcggctcgcttcccgagcccgggatggagcaccgcgcctagggaggccgcgccgcccgagacgtgcgcacggttcgtggcggagagatgctgatcgcgctgaactgaccggtgcggcccgggggtgagtggcgagtctccctctgagtcctccccagcagcgcggccggcgccggctctttgggcgaaccctccagttcctagactttgagaggcgtctctcccccgcccgaccgcccagatgcagtttcgccttttctcctttgccctcatcattctgaactgcatggattacagccactgccaaggcaaccgatggagacgcagtaagcgaggtgggtccttctctgccaaagctagttatgtatcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaatttataaacttccagaggaagatatgttccaccttggaaaggattcctgttcagatttctttagactacctatggcgggggtggtggtttga

SEQ ID NO: 218 - DNA, 4008 bp, Homo sapiens
  CDS (267)..(2333)
aagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcat

SEQ ID NO: 219 - DNA, 503 bp, Homo sapiens
  CDS (112)..(417)
cggacgcgtgggaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtg

SEQ ID NO: 220 - DNA, 3304 bp, Homo sapiens
  CDS (39)..(2027)
ctttctccacgataatctaaagtaaagataaaaacaacatggctgcaaaggagatactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataaaaaaaaaaaaaaa

SEQ ID NO: 221 - DNA, 3032 bp, Homo sapiens
  CDS (144)..(3023)
cgcggccgcgtcgactttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgacttttttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtc

SEQ ID NO: 222 - DNA, 1060 bp, Homo sapiens
  CDS (62)..(802)
gtgtgactgaagaggagctcacagttcccagcgtctgctcccacggtgtccagcgcccagaatgcggcttctggtcctgctatggggttggctgctgctcccaggttatgaagccctggaggggccagaggaaatcagcgggttcgaaggggacactgtgtccctgcagtgcacctacagggaagagctgaggggacaccggaagtactggtgcaggaagggtgggatcctcttctctcgctgctctggccacatctatgcagaagaagaaggccaggagacaatgaagggcaggttgtccatccgtgacagccgccaggagctctcgctcattgtgaccctgtggaacctcaccctgcaagacgctggggagtactggtgtggggtcgaaaaacggggccccgatgagtctttactgatctctctgttcgtctttccagggagctcccgcccccccatgcagctggactccacctcagcagaggacaccagtccagctctcagcagtggcagctctaagcccagggtgtccatcccgatggtccgcatactggccccagtcctggtgctgctgagccttctgtcagccgcaggcctgatcgccttctgcagccacctgctcctgtggagaaaggaagctcaacaggccacggagacacagaggaacgagaagttctgcctctcacgcttgactgcggaggaaaaggaagccccttcccaggcccctgagggggacgtgatctcgatgcctcccctccacacatctgaggaggagctgggcttctcgaagtttgtctcagcgtagggcaggaggccctcctggccaggccagcagtgaagcagtatggctggctggatcagcaccgattcccgaaagctttccacctcagcctcagagtccagctgcccggactccagggctctccccaccctccccaggctctcctcttgcatgttccagcctgacctagaagcgtttgtcagccctggagcccagagcggtggccttgctcttccggctggagactgggacatccctgataggttcacatccctgggc

SEQ ID NO: 223 - DNA, 2304 bp, Homo sapiens
  CDS (200)..(2002)
aggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaattcctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaaaaaaaaaaa

SEQ ID NO: 224 - DNA, 2641 bp, Homo sapiens
  CDS (22)..(1587)
cggcacgagggcagccacaaaatggcggcgggtgggagcggcgggcgtgcgtcgtgcccgccgggggtcggggtcggcccgggcacggggggcagtcccgggcccagcgccaacgccgccgccaccccggcccccggcaacgcggccgccgccgccgccgccgccgccgccgcccctgggccgacgccgcccgccccgccgggccccgggacagacgcgcaggccgcgggcgcggagcgggcggaggaggcggcgggcccgggggcggcggcgctgcagcgcgaggccgcgtacaactggcaggccagcaagcccaccgtgcaggagcgcttcgccttcctcttcaacaacgaggtgctgtgcgacgtgcacttcctggtgggcaaggggctcagctcgcagcgcatccccgcgcacaggttcgtgctggccgtgggcagcgctgtctttgatgccatgttcaacgggggaatggccacaacatccacggagattgagctgcccgacgtggaacccgccgccttcctcgcactgctcaagtttctctactcggacgaggtgcagattggcccggagacggtgatgaccacgctatacaccgccaagaagtacgcggtgccagcgctcgaggcccattgcgtggagttcctgaagaagaacctgcgagccgacaacgccttcatgctgctcacgcaggcgcgactcttcgatgaaccgcagctggccagcctgtgcctggagaacatcgacaaaaacactgcagacgccatcaccgcggagggcttcaccgacattgacctggacacgctggtggctgtcctggagcgcgacacactgggcatccgtgaggtgcggctgttcaatgccgttgtccgctggtccgaggccgagtgtcagcggcagcagctgcaggtgacgccagagaacaggcggaaggttctgggcaaggccctgggcctcattcgcttcccgctcatgaccatcgaggagttcgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggcccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggagacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgcaaaaaaaaaaa

SEQ ID NO: 225 - DNA, 1029 bp, Homo sapiens
  CDS (149)..(982)
gcgacgcccagaccgccggtcccggggccccctgggccacgccgatcacggggagcccctcgactgcctcccagaacaaagtgggaaagggaagcttagcccgccgctgccgcctccgagcagcccgccaggactctggctactggagatgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctacgtatcttttgagcagtacgggagagacgtgagttcctgggtggggcactacggcgcccttgtgacccactccagtgtgagggtcaggatccgtctgtcctagcgactggactactgcctgacgttgtcagtcaagaccagccttgc

SEQ ID NO: 226 - DNA, 1437 bp, Homo sapiens
  CDS (32)..(1255)
atttggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtgaggaccttgaagaaactgcatggttggatcagtctgatgaagcacttgaggcttcctgagcccaggcagatgtgaactcctggcaaggggtgggcaggtccagtttactaagtgagggtccagcccgagggctggcactggaatgcagtcctcagagcggttgtggtcatagaccgcgag

SEQ ID NO: 227 - DNA, 2152 bp, Homo sapiens
  CDS (32)..(2149)
atttggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgaggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcattagtctcaccatgaactccaaactccttgatggttcccagcgggtggtgatgggcggcgtaatctctgaccaccaatgtcaggagctgcagagactgaccaatggggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaagtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatga

SEQ ID NO: 228 - DNA, 2242 bp, Homo sapiens
  CDS (32)..(2239)
ggctggcggttccgttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctactcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaagctggtgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttaccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaagtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatga

SEQ ID NO: 229 - DNA, 2412 bp, Homo sapiens
  CDS (250)..(1416)
attctgggagtcaccgcagccaagtttttctgccccaacttgtcggccatttctaccacactgaagctctcccacaacgtggcaggcgtcaccttcctggcatttgggaatggtgcacctgacatcttcagtgccctggtggccttctctgacccgcacacagccggcctggcccttggggcactgtttggcgctggcgtgctggttaccacagtggtggccggaggcattaccatcctacaccccttcatggctgcctccaggcccttcttcagggacatcgttttctacatggtggctgtgttcctgaccttcctcatgctcttccgtggcagggtcaccctggcatgggctctgggttacctgggcttgtatgtgttctatgtggtcactgtgattctctgcacctggatctaccaacggcaacggagaggatctctgttctgccccatgccagttactccagagatcctctcagactccgaggaggaccgggtatcttctaataccaacagctatgactacggtgatgagtaccggccgctgttcttctaccaggagaccacggctcagatcctggtccgggccctcaatcccctggattacatgaagtggagaaggaaatcagcatactggaaagccctcaaggtgttcaagctgcctgtggagttcctgctgctcctcacagtccccgtcgtggacccggacaaggatgaccagaactggaaacggcccctcaactgtctgcatctggttatcagccccctggttgtggtcctgaccctgcagtcggggacctatggtgtctatgagataggcggcctcgttcccgtctgggtcgtggtggtgatcgcaggcacagccttggcttcagtgaccttttttgccacatctgacagccagccccccaggcttcactggctctttgctttcctgggctttctgaccagcgccctgtggatcaacgcggccgccacagaggtggtgaacatcttgcggtccctgggtgtggtcttccggctgagcaacactgtgctggggctcacgctgctggcctgggggaacagcattggagatgccttctcggatttcacactggctcgccagggctacccacggatggcgttctccgcctgctttggcggcatcatcttcaacatcctcgtgggtgtggggctgggctgcctgctccagatctcccgaagccacacagaagtgaagctggagccagacggactgctggtgtgggtcctggcaggcgccctggggctcagcctcgtcttctccctggtctcagtcccattgcagtgcttccagctcagcagagtctatggcttctgcctgctcctcttctacctgaacttccttgtcgtggccctcctcactgaatttggagtgattcacctgaaaagcatgtgactgaagccgcttagtgctgtggcctcactgcaggcaggagccccgcccctcctgccgggggaggcccagggaccggagcatttctgcaaggcccttgtgggcacgagagtgcggcccttgctgctggagatctgaggtcactgctgtgagctgggagaactgctgtgtacctcttgctgccagcacccaacagccttgccgtggggaccttggaaacctggctttgctctggacaaagggttccagagagaagctagaagtcccccttgaatgacccccagagcccctctgagaagggctggagtttgggggaaggggatggctggatgtgctccaggccatgctggaggtacccccgaggcacaggcactgcccgttccccttgcctgggcttcaggccttctggcaccttctcaggacacaagtggctgcccaaccctgactcagagaatgagggtggcttggacccctgggaatcaggccgccgagggctgagctccagagccgcaccatctgccacaaacagaattcgagacatacttaattttgaatttctccttgccacgttaataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgaccccgccttatgttgccgaaataagcaactcttaggtttgcctgactgccttatgctggtaaagaaaagggattcaactgtctcttttccaaataaaaaaaaa

SEQ ID NO: 230 - DNA, 349 bp, Homo sapiens
  CDS (35)..(250)
atatcgtcgacccacgcgtccgcgtgctaccagaatggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacgtaagcactgagaaaaacgttgctttttgtccaattctctgttgataatgaccacacaatgacctcatggcattaaaatacatgagaaacaaaaaaaaaa

SEQ ID NO: 231 - DNA, 3782 bp, Homo sapiens
  CDS (250)..(2610)
tcccgtgtcgacgatttcgtggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcctttgataaaatacagcagctaaaattctctcagattgtgaatttgaaaggtaaaggacatggcctgtctatcacacctctgccagctggtcatatgataggtggaacaatatggaaaatagtcaaagatggagaagaagaaattgtttatgcagttgacttcaaccacaagagggagatccatttaaatggatgttccctggaaatgctaagcaggccttccctacttatcacagattcattcaatgctacatatgtacagcctagaagaaaacagagagatgagcagcttctgacaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaagacttattatttagaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaaaaaaaactgataaaacagtttttcgaaacttacttttaaaagcatacgttctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttct

SEQ ID NO: 232 - DNA, 1606 bp, Homo sapiens
  CDS (25)..(1290)
ggcacgaggaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaaaaaa

SEQ ID NO: 233 - DNA, 575 bp, Homo sapiens
  CDS (97)..(441)
  misc_feature (1)...(575): n = a,t,c or g
ccatttccccaggaccagattgacatatttcgatttaatcactcctatagggaattgncctcgaggcaagattcgcccgaggggtcttctgccatcatgccgatgttcatcgaaaacacacaggtgccccgcgcctccgtgccggacgggtccctctccgagctcacccagcagctggcgcaggccaccgcaagcccccgccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaa

SEQ ID NO: 234 - DNA, 2107 bp, Homo sapiens
  CDS (48)..(2057)
cctgcctgaggctgatcattaacccagaacttatataaagatggctcatgcgtggaatgggtatagcactgcctgcagccatggccagtacggttagccccagcaccatagctgagaccccagagccacctccattgtctgaccacatccgaaatgctgctgacatctcagtcattgtcatctattttctggtggtgatggctgttgggctgtgggcgatgctgaagaccaaccgaggtactataggaggcttcttcctcgctggtcgtgatatggcctggtggccgatgggcgcctctctctttgccagtaacatcggcagcaaccactatgtggggctggctgggacaggagcagcttcaggagtcgccaccgtaacatttgaatggacttcctcagtaatgttgctgattcttgggtggatctttgtccctatctacatcaagtcgggggtgatgaccatgccggaatatctcaagaagcggtttggtggggagcgactccaggtctacctctccatcctctccctcttcatctgtgtggttttgttaatttctgcagacatatttgctggagccatattcatcaagctggccttgggattggacctttacctggcaatcttcatcctcttggctatgactgctgtttacaccaccactgggggcttggcctcggtgatttacacagacaccctccagaccatcatcatgctgattggctcttttattctcatggggtttgcatttaacgaagttggaggttatgagagctttaccgagaagtacgtgaatgccaccccatccgtagtcgagggggacaacttgacaatcagtgccagttgctacacacctcgggcggactccttccacatcttccgagatgctgtgactggggacattccatggccaggaattatatttggaatgcccattacagctttgtggtactggtgcacaaatcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacagatatggtagcatgtgtggtaccttctgaatgcgtgaaacactgtggcgttgatgttggctgcaccaactacgcataccccacgatggtgctggaactgatgccccaaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggatatttgttcttctattaactgttgtgagcattgtgtgggtcccactggtacaagtttctcaaaatggacaactaatccattacacagaatcaatttctagctaccttgggcctccaattgcagctgtctttgtgcttgccatcttctgtaaaagagtcaatgaacagggagcattctggggtctaatggttggacttgcaatgggcctcattcgtatgataacagagtttgcttatggaacagggagttgcttggctcccagtaactgtcccaagattatctgtggagtgcactatctgtacttttccatcgttctcttttttgggtccatgctggtcaccctgggaatttccctcttaacaaaacccattcctgatgtacatctgtaccgcctgtgctgggttcttcggaacagtacagaggagcgaatcgatatagatgcagaagagaaaagtcaggaagaaacagatgatggtgttgaagaagattatcctgagaaatcacgtggatgcctcaagaaagcttatgacttgttctgcggtttgcagaagggacccaagctaaccaaggaggaggaggaagccttgagcaagaagctcacagacacgtctgagaggccctcgtggaggacaatagtgaacatcaacgccatcctcctcctggctgtggtggtctttattcacggctactatgcctgaactctatctgagccattagaataatgaataattcttaaaaaaaaaaa

SEQ ID NO: 235 - DNA, 2335 bp, Homo sapiens
  CDS (217)..(1182)
cacgcggagccagagccggagctgcagccagcagcgggaagccgtgggagctcaggggccgcaggagccgggccggagtgagcgcacctcgctggtggccctctggtggcagtgtgtggtgatgcgccacccgtgagtcccgctgcgcaactttcagggcgcactcggcggggctggctgcgcggctgcctgggactcggctgcgggactgcatggatggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttataaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagtaaaaaaaaaaaaa

SEQ ID NO: 236 - DNA, 1362 bp, Homo sapiens
  CDS (54)..(1148)
caggaaagtggaaaagaactcaggtccccctacttggtgaagagtgcgcagacatggacctcgccagaaaagaatttctgcgtggaaatggcttagctgctgggaaaatgaacatcagtattgatttagacacaaactatgctgagctggttctaaatgtgggaagagtcactcttggagagaacaatagaaaaaaaatgaaggattgtcaactgagaaaacagcagaatgaaaatgtctcacgagctgtgtgtgctctgctgaattctggagggggagtgatcaaggctgaagttgagaataaaggctatagttataaaaaagatggaatagggctagatttggaaaattcttttagtaacatgctgccatttgttcctaatttcctggacttcatgcagaatggtaactactttcacatttttgtgaaatcatggagcttggaaacctctggtccgcagattgccacgttgagctccagtttgtacaagagagatgtaacgtctgcaaaagtcatgaatgcttctgctgcactggagttcctcaaagacatggaaaaaactggagggagagcatatttaagaccagaattccctgcaaaaagggcctgtgttgatgtacaagaagaaagtaacatggaagccttggctgctgatttttttaacagaacagaacttggttataaagaaaaattgacctttactgaatccacacacgttgaaataaaaaacttctcgactgaaaagttgttacaacgaattacagagattctccctcaatatgtttctgcatttgcaaatactgatggaggatatttattcgttggtctaaatgaagataaagaagtaattggctttaaagcagagaagagttatcttactaagttagaagaagtaacaaaaaattccattgggaaactgcctgtgcatcacttctgtgtggagaaggggacgataaattacttatgcaaattccttggagtatatgataaaggaaggctttgtggatatgtgtatgcactcagagtggaacgcttctgctgtgcagtgtttgctaaaaagcctgattcctggcacgtgaaagataacagagttaagcagttgaccgagaaggaatggatccagttcatggtggattcagaaccaggttgaggaaggaggattggcaataaggatacctttggcttgggtggcaggaaggttttattgtatctttgggattagggacaagattaaaagtcttcaaatttcaacatctctggtggatacaaccaatacttccctgcctcttgttttcttctgcacacttagaagatagatattccatacaataactaaatatctactcttagtagccttatct

SEQ ID NO: 237 - DNA, 1969 bp, Homo sapiens
  CDS (56)..(1915)
gtgggctgggtgggtttcctaatctggtttcgtctgcttggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcaggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtagacccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaaatcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacagggtaaatacaaggagctgaaaaaatgaagagagtttcaagaagtttttaaccgaagtgtcatgattattgcagcaaca

SEQ ID NO: 238 - DNA, 3225 bp, Homo sapiens
  CDS (1)..(3222)
atgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgtctctctccaccacagatcctgggcctcatcatcgttcgaaggcttctggatttcatcttttcccagcacgacctggcctggattga

SEQ ID NO: 239 - DNA, 1100 bp, Homo sapiens
  CDS (193)..(855)
agaagggatgctgggtccagcttcctttgcgaggccttggaggggcagggggtatacaatttgccccacccataccctcataagcccaacccggcctccagcctcccttcttccccaccgagacttctctgccttgcttgagctggactataaacctctccactcctgaaggcggggccagcccccctgagcatgataaaacccaaatgggggggtctggtgtgggcacagccatggcatggccctctggcacggccctctggcaccttaccctttgccagctccatgcccagccctgtggatgcatcctcagcagacggtggcagcgggttgggttcccaccggagaaagcggaccaccttcagcaaagggcagctactggagctggagagggcgtttgcagcatggccctaccccaacatcagcacccatgagcacctggcctgggtcacttgccttcctgaggccaaggtacaggtgtggttccagaagcgctgggccaaaataatcaagaacaggaagtcaggaattctaagccctgggtctgagtgcccccagagctcctgttctcttccagacaccctccagcagccctgggatccccaaatgccaggccaacctccaccctccagcggcacacctcagcgcacctcagtgtgtcgacatagctcctgtccagctcctggcttgagtccacggcagggctgggaaggggctaaagctgtagccccatggggatcagctggggcttcagaggtccacccttctttagagcgagctactccccagacttcactaggcagcctgtctgacctcatctatgcctcggccattgtcgtcaatgtggaccactcctagtctttgtccagaacttgcaaggcccctcctctgactcctgtggcccaccctgcccctcctgggattgaacacatcagaagtggattccctggccccactttttatgcaaagggattccctacgggaaaggagtttagctcaggcatccctcccttccactggcctccaggccagcctagatgcaggtcctaagcagactggggcctggctcctgccaccccacaccctgacccctttggggg

SEQ ID NO: 240 - DNA, 1020 bp, Homo sapiens
  CDS (371)..(661)
ctagatgagcaaaatagacagagagtagctataatcagtgtagaacagacatacatctgatattgagtataaattacaagagctttggggtgatgataagcatcgtcactgaggacgttgctgaaatgaagaatgtccagtccagtgaggggcctgtcgtgggaactcggtgggaggggatgcatcctcttcactgtgaccactgccacatcctggcattccctggtcagttgaccttgaaccggctgtgcaggtccagcaggaggccagctggcttcctaggagtctttttccctctgctcactctgctgtgtttgcgggtttcctagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaaggtaacagcctgggtcctgtctcccaacagttggagggggttagggagttggaaggagggcaccaaagcctagctgatgccaccagggtggtacagaccacctctgttgatgcgcgcgcaggagactgtgagcagatgccacactaggtgggtgctggactggagcctggggaagaactagaggggctggaagggcgcagggaggtctgccagggtgaagggacagcctaggggaaacccagctcggaacccacaaggcagggcagctggagcgtgcagtctggtctccccgtgttcaagctctcactgtggggcttcatctagtgcatgacacccctgggagcacaaatgcctgctcctactgataaagaagcagggggagtgagcggctcccaagcagcggcgcaggagcgaaggcaggtctagacatccctgccctttttcccatcacagcagtctctgcagttgctgctgaggtcgagtttccgaattgaggtgctgct

SEQ ID NO: 241 - DNA, 5619 bp, Homo sapiens
  CDS (255)..(5531)
ggtcaagatgcttataaaagcgtctctactcccttaactactttggatgctacttctgataaaaagaagaaaacagtttaagctatgaagaaggacatccctcacactctgaaacagatctccttcagagacagagttttgcagcctctcatcagcttcctggatatgctcccacacctcagcctactggtctttctggaatatttgatactagtgtgaacagtgccagcagtaacactaaagagtcttcagtgatgaattttctgtctactgctgaatcccgaactgctcaggctgctgcttcaggaactactctcttaccacaattcagggctccatcctggcagacaggcatgcattcctcagcagcaactgagctgtttgttactggacctttgccaagcactggaacacttccaccatctctctctgcttatcagcatcccaccaccttcagcaatagaaactttgctaccacttcacctttggtgcttcaggattcaacttttaacactacatcaaatggaattttaagtcatcatgaccctttgctacaaatcaagacttcccagggaactgttccaactgctttggcatttgagcgcctgggcagttctgtattaagtaacagcataccacctcagtcttcaacataccgctcagctcaagagtctgcaccccatcttttacaacctcaatttagtttgttgccttcagcacttgggggatcccagcagactcctcaagcctacagttcaactctctttactagttctactgcttccattgaaagagctcttcttcgagaatgtagtgttattaaacaccatcagcggccttcaggtacccagtcaattcaggcacaactgactggttcacagcactccttacatagttatctatcaaattcaagtgtagttaattttcaggaaacaaccaggcagtcatctttatcctgtagcccaattggagattccactcaggtgagcaacggaggattacaacagaagacctcccaggtctcagtggaacttgctcagtcttactcatctgcgattccatcatcagggtatcctccttctactacaaaaataaaaagctgttctacagaacaaccactgacatcaaccaagacccctaaacctcaaagtataattcctcctgtgcaaacactaagctattccaaacctttacataatcagagttctgtaatatcgggccaagcacaaatttattctacagcgcagctaccaagccttttatcagttagtcagtcccaaaattacggtttagtacagccacataatgtgccatctattgttcattcacaggtttataggtccagcaaggttgagaaattgccacccttgtataaaacattgactttttctgggtcatctcagactataactcctgaaaatcagacgcttaattattcatctaatcagcaagaggtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaaaaaaaaagtgttgttggttcagtgacacaacttaaccaacaaattggccaagtcaataatgcagctacccttgatcttaagaactcaactaatttaatacagactccacaaataaggttgaatactaaagacttaaagcagcaacatcctctcatacttaaggtgcatgagtccaaggtccaggaacagcacgatcaaataattaatgcttcatctcagattcaaattccaaatcatgctttagggcatggccatcaggcatctcttcctaatacacaggtccttttagattctgcctgtgatttacaaattcttcagcagtcaatactgcaggcaggtttaggtcaagtaaaggcatctttacaagcacagcgtgttcaaagccctcaacaaatagtacatcccttccttcagatggaaggtcatgttattcaaagcaatggtgatcattctcagcagcaactccatcctcaaaattctgaagttatgaaaatggacctctctgagtcttcaaaaccattacaacaacatctaacaacaaagggccattttagtgaaacaaatcaacatgattcaaagaatcagtttgtttctcttggatcgatgtgtttcccagaggcagtgcttcttagtgatgaaagaaatattttatcaaatgtagatgatatcttagcagctacagcagcagcttgtggagttacacctactgatttttccaagtcaacttcaaatgaaaccatgcaggctgttgaagatggtgattctaaatctcattttcagcagtcattagatgtcaggcatgtgacttcagattttaactctatgacagctacagtaggaaagccacagaatataaatgatacttccttaaatggaaatcaggttactgtgaacctttcaccagtacctgcccttcagtcaaaaatgactcttgatcaacagcacattgaaacacctggtcaaaatataccaactaaagtaacttcagcagtggttggaccaagtcatgaagtccaggagcaaagttctggcccattcaagaaacagtctgctaccaatcttgaatctgaagaagacagtgaagctcctgttgatagtacattaaataataacagaaaccaagagtttgtttctagtagtagaagtataagtggagagagtgctacatcagagagtgaatttaccttagggggtgacgacagtggtgtgtcaatgaacccagctaggagtgcacttgcactgttggccatggcccaatctggggatgcagtcagtgtcaagattgaagaagaaaaccaagatttaatgcattttaaccttcaaaagaaaagagctaaaggaaaagggcaagttaaagaggaagacaacagtaatcagaaacagctgaaaagacctgcccaaggcaaacgccagaatccaaggggaacagatatttacttaccgtatactcctccttcctcagaaagctgccatgatggttatcagcatcaagaaaaaatgagacagaagatcaaagaggtggaggaaaaacaaccggaagtcaaaacaggatttattgcttctttcttagattttctgaaatccgggcccaagcagcagttttccactcttgctgtacgaatgcctaacaggactagacggccagggacccagatggttcgtacattttgtcccccaccacttcccaagccttcatctacaacacccacacctttagtgtctgaaactggcggtaacagtccatcagataaagttgataatgaacttaaaaacttggaacatttatcttcattttcttctgatgaagatgatcctggatatagtcaagatgcttataaaagcgtctctactcccttaactactttggatgctacttctgataaaaagaagaaaacagaagccctacaggtggcaactactagcccaactgccaatactactggtactgctactacttcctcaaccactgtgggtgcagttaagcaagaacctctccactctacttcatatgcagtaaatattctggaaaatataagctcttcagaatcctcaaagcccattgaacttgatggtcttccttcagaccagtttgcaaaaggacaggacactgttgccatagaaggttttacagatgaggaggacacagaaagcggaggagaaggccaatacagagagcgtgatgaatttgtggtaaagatagaagacatagagacttttaaggaggctttaaaaacaggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccttccgtgaaacccaaagttaaacagccaaaagtaaaggctgagccaccaccaaagaaacggaaaaaatggaaagaagaattttcatcatcccaatctgactcatctcctgagatccatactagtagtagtgacgatgaggaatttgaacctcccgctccctttgtcactcgctttttgaacacaagagcaatgaaggaaacctttaagagctacatggaattgcttgttagcattgccttggaccctgacacaatgcaagccttagagaagagcaatgatgagctacttttacctcatatgaaaaaaatagatggcatgctaaatgataaccgaaagagacttcttttgaatcttcatttggatcaatcattcaagaatgctttggaaagttttcctgaactaacaataattactcgagattctaaagcaaagagtggaggaactgctatttctaaaatcaaaatgaatggcaaagcctataataagaaaactctaaggacttctaaaacaacccccaaatctgcacaagagtttgctgtcgatccagagaaaatacagttgtattctttgtatcattcactccatcattataagtaccatgtttatctgatatgtaaggatgaggtaatttcttctcatttacttaaaaaaaatgtttttcagaatgttaaggagactctagccatagtattttggagtgttttaaagagagttgtgaaatacatgtgtgtatgtattttgtctatgtattctgtaaataatgacttgatttattgttctgagtctctctgctatgttttgtgctcagatttacccgagcctccccccctcttgtaggagctataattggtaatgttttgaagctgttggggcttgctttacatcgccataataaatgatgtttttttgcaaaaaaaaaaaa

SEQ ID NO: 242 - DNA, 1858 bp, Homo sapiens
  CDS (145)..(870)
gcccattgcgtatatcaagaaatggggggtaactttagcttgacaatagatatcccttggccggactttgaggagcatttgaagtgctttgcccaaacttaattagcgtgagaaaatggatgggggaatggaaagtatcttggcatgaataaggagctatatatgattggttgggatcgtagccaaaaccttgtggacatttgtagagagaggcaatttcaggcttttgtctgtgatgcattggcagtaccagtccgcagtgggtcttgtgatgcctgcatctccattgctgttattcatcattttgcaacagcagagcgtagagtggcagctctccaagaaattgttcgactcctgagaccaggtgggaaggcactcatttatgtctgggcaatggaacaagaatataataagcagaagtccaagtatcttagaggaaacagaaatagccaaggaaagaaagaggagatgaacagtgatacctcagtgcagaggtcacttgtggagcaaatgcgtgacatgggcagtcgagactcggcatcttctgtcccccgcattaatgactctcaggaaggaggatgtaattcaaggcaagtttctaattccaagctgcctgttcatgttaacaggacttctttttattctcaagatgtactggttccctggcaccttaagggaaatcctgataaaggcaaacctgttgagccatttggtcccataggatcccaggacccaagtcctgtgtttcatcgttactaccatgtgttccgtgagggagaactggaaggtgcctgcaggactgtgagtgatgtcagaattctgcaaagctactacgatcaaggaaactggtgtgtgattcttcaaaaggcctgattatttacctgaacacatcatatataaagaagaaatgctcacttaaaaaaaaaagagagaataaattaattacccttttaattaaagagaaaacttgtgggaaagtaccaaaggaaagctgagaaaaatttggaagtagggattcattaggagacattcaaatgtctcctgttggctgacatcacagatgtggtgttggctcctcctacttccctaggagaggtggtttctaaaagtgattgaagcagtttgtgcagtgtttgtaattcttgggtaagagcccaggattttgaagataatagttttttagtaaagtgctactaaatgtagtaaatcatgtaggattttagggatgtaattatatgttaatacagaaaatagtcctggtcaatagaaaattgtctgaagttttacctatgatttttagctctgtaaaatcatagacaataaccattctatttccatgcctgactagcccagggctggacgtatagcgggtgtccaataacgtttagtcaatcagataatacccagaacttagtaggagtttcattcaaaaactattttttgaacccaaccatgtaccagttactattttaagtactgataatgaagcagtgaataagaaagagcaaagctcttgcccttatggtgcttacattctagacggggagacagacagcaggcaaatcaataaatagatactatgtgccagatagtgataaatgccatgaaaaacataaaatgagagacgattcaccttggagcaaaagattacttttaagtgactgaaataactactaatcctgactaatttattatcaagagttaattggtattccaaattcatttgagcaggctgctaaaaacaacccaaatgtgcctccttttaacctcctttgtttaaatgacaaaagttagaatgttggtcactcagaacctaatgtgccctttagagccaaaagctgggtgtcattattgggta

SEQ ID NO: 243 - DNA, 1734 bp, Homo sapiens
  CDS (208)..(1695)
gcgagtattttccacataagctggctgtcgtttttctcctggcctctgtggaggcgagtggtctgcgggcacagctcccagaggcagccttggaattccagctcggactgggcgggaaggcgcaggcggcccaggtcgccgacacgctcacgcaccctccctgcctggccgcgcctctgcgaccaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaattatcagcaggaaattttccgagaagctggtagaatttccattgctagcctcttggtaccagaggattcaggaagtgccaggagtaaaaacagcagcttctaagtgtgggatccaatttctccatttaccaaagttgttgacaacctcaactgaacagcatccaaacttatgtgaagtcccaggtgtagaagagcaaagcgatcctttatttataggaggaccaagaccaaccatggccaagttaatggaaaagggcattgaagtgatgttttctccccacccttgccctacttggactcttgattggaatgttctccctgcagcagtcagcccaaaggaaggtaaaatgtccagtgatcgagctttgaggaagcagcaacagttgaacaaccttgtctatgtggtaacaaatcaggccaaacctggtgacagaattgtggatttctgcagcggtgggggccatgttggaattgtccttgctcacatgctgccatcatgtcaggttacattaatagaaaacaaggaattatcattaattcgtgctaagaagagaacaacctcattgagctgttacaaaaaaggattgatataataaataaaatatgcttagcacatcgtaaaaaaaaaa

SEQ ID NO: 244 - DNA, 1823 bp, Homo sapiens
  CDS (99)..(1820)
gcacgagtggccttacagtcgtagaactgattggctgatcatgaccatgcagttagccagggttttcccgagttgtttgggttgagttcaggagaagcatggccaggtcgagtccgtacctgcgccaacttcagggacctctgctcccacccagggatctggtggaggaggacgacgactacctaaacgacgacgtggaggaggatgaagagtccgtgttcatcgacgccgaggagctctgcagtgggggcgtaaaggctggcagcctccccgggtgcctccgcgtttctatttgtgatgaaaacacacaagagacatgtaaagtgtttggacgttttccgataacaggtgcttggtggagagtgaaggtacaagtaaagcctgtggtgggatcaaggagctatcaatatcaagttcaaggatttccgtcttactttttgcagtctgatatgtcaccaccaaatcaaaaacatatctgtgctctctttcttaaagagtgtgaggtctccagtgatgatgttaataaatttttaacatgggtaaaggaggtatcaaactacaaaaacctaaactttgaaaatcttagggaaacactaagaactttccacaaggaaactggaaggaaagatcaaaagcagcctacacagaatggtcaggaagagttgttcctagacaatgagatgagtcttcctctggaaaacacaattccatttagaaatgtaatgacagctttgcagtttccgaagataatggaattccttccagttcttctgcctcgacactttaaatggatcatagggtcaggttctaaagagatgttgaaagagatagaagagattttaggtacacatccgtggaaacttggatttagtaaaataacctacagagagtggaaactcctgcgatgtgaggcaagttggatagcattttgtcagtgtgagtctcttctccagctgatgactgatttggagaagaatgcattaataatgtattccagactgaagcagatatgtagagaagatgggcacacatatgttgaagtgaatgacttaactttgacattgtcaaatcatatgtcatttcatgctgcttcagagtctctgaagtttttgaaggatattggtgtggtgacatatgagaagtcctgtgtcttcccttatgacctttaccatgctgaaagagccatcgccttttcaatttgtgacctgatgaagaaacctccttggcatttatgtgtcgatgtcgaaaaggtgcttgcctctattcacaccacaaaacctgagaattcaagcgatgatgcattgaatgagagcaaacctgatgaagtaagattagaaaatcctgtggatgttgtggacacacaggacaatggtgaccatatttggactaatggtgaaaatgaaattaatgcagaaataagtgaagttcagctggatcaggatcaggttgaagttccactggatcgggatcaggtggctgctttggaaatgatttgctccaatcctgtgacagtcataagtgggaaaggtggatgtgggaagaccacaatcgttagacgtctttttaagcatatagagcagttggaagaaagagaagtaaaaaaagcctgtgaagattttgaacaagaccagaatgcttcagaagaatggattacctttactgagcaaagtcaactagaggcggacaaggctatagaagttttgctcacagcacctacagggaaagcagctggcttactaagacagaaaactggtcttcatgcctacacactgtgtcaggtgacattagacagttacccagtattgaacctggtaacttgctga

SEQ ID NO: 245 - DNA, 1606 bp, Homo sapiens
  CDS (63)..(1370)
tgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgatgagacctgcacgcagtggctcacagcagcacgatttgtgacagcccgaggcggagaacaccgaacacccagtgaaggtgaggggatcagcacggcgcggccacccacgcacccacgcgctggaatgagactcagccacaaggaggtgcgaagctctgacccaggccacagtgcggatgcaccttgaggatgtcacgctcagtgagagacaccagacacagaagggtacgctg

SEQ ID NO: 246 - DNA, 2500 bp, Homo sapiens
  CDS (308)..(1015)
ctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccatgtctggtcaccagtgagcagaagatacacagtgaccccacctcacttgctccttttgtttcagaaagcccagagggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcat

SEQ ID NO: 247 - DNA, 3054 bp, Homo sapiens
  CDS (342)..(2816)
tttcgtctacgcctttgcaggttggcgaagtggttccaggctacccggctagtctggcacggccccgtcttctgcctcctcctccgtcgcggggcggcgggaactgttggccgcgcggcctcgggaacggcccaggtccccgcccgcaggtcccgggcagataacatagatcatcagtagaaaacttcttgaagttgttcaagaaaaatttgaaagtagcaaaatagaaaataaagaattaacagcagatacagaggacagcatggaagtgttgtcttaggaaacagaacacagcagtgaaaaaacagacaaaatccgctcagatacaactgcagctgataatgttttccggcttcaatgtctttagagttgggatctcttttgtcataatgtgcattttttacatgccaacagtaaactctttaccagaactgagtcctcagaaatattttagtacattgcaaccaggaaaagcctctttagcttatttttgtcaagctgattccccaagaacatctgtatttcttgaagaactgaatgaggctgttagacctctgcaggactatggaatttcagttgccaaggttaattgtgtcaaagaagaaatatcaagatactgtggaaaagaaaaggatttgatgaaagcatatttattcaagggcaacatattgctcagagaattccctactgacaccttgtttgatgtgaatgccattgtcgcccatgttctctttgctcttctttttagtgaagtgaaatatattaccaacctggaagaccttcagaacatagaaaatgctctgaaaggaaaagcaaatattatattctcatatgtaagagccattggaataccagagcacagagcagtcatggaagccggttttgtgtatgggactacataccaatttgtcttaaccacagaaattgcccttttggaaagtattggctctgaggatgtggaatatgcacatctctacttttttcattgtaaactagtcttggacttgacccagcaatgtagaagaacactaatggaacagccattgactacactgaacattcacctgtttattaagacaatgaaagcacctctgttgactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatagatgttcaggatgatgaagtggcagaaactgttttcagagataggaagagaaaattacctttggaacttacagtggaactaacagaagaaacatttaatgcaacagtgatggcttctgacagcatagtactcttctatgctggttggcaagcagtatccatggcatttttgcaatcctatattgatgtggcagttaaactgaaaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccaaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcaatataaaaaagcaatattgacactggtaaagcagaaatacttggattcatttactccatgctggttaaatctaaagaatactccagtggggagaggaatcttgcgggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgatagacttaatttatttccttaaagaataatattaaatcatttcaagtttgcagactagtgccatccaatagaattataatataagtcacatattttatttaaaattttctagtaactacattaaacaaagtaaaagtgagcagggcaaaataattttgatattacttttcacccagtagtatacccaaaatagcga

SEQ ID NO: 248 - DNA, 844 bp, Homo sapiens
  CDS (267)..(599)
ggaggggtagcgattacttttcctcgtgagacacgtcccactgccttgttgcagtggcccaaggagcggaggatcgggtccacccaaagtgaggaataaatccggactttcagcaacgtgggcaggaaggagccttaaaattcccaggcaagtgggtaactctgtgcacagaccaagccgccgacgggaccatcacaaaagctttacaaggccttaccaccctggcaaatgaattagccgaaaattctggactagataacccttttatgggtctcatggaaaagtggtttggaaaatggaaaggactcctggcttcaatctttacctctcttgcaattgtaacaagtgtacttatccttgtgggctgccgcatcataccttgtattcgtgggttaactcaaaggctcatagaaacagccctcactaaagccttcctctcttctctccctccatacttggacaagctcttgctcctggataatcaagaagaacaacgaagccaaatcctgttaaaattttttgcagaggaagaagtatcaaatagaagagaggaaattgttgggacagctaagctcttcaaagactcaacttcctggtcataaacttctccccgtttttcttctttttcgccagtctaccctgtttgggaaagtttaaaccttagccagtcgggatcagctcagattgtgcagtccatccccagtcaatggggaaaggacacagaaacaggaactgcgttagggttaaaaagcccttctctcctttgtttggggtgctcttgcgattacaagctgcgcaagtagcaccgttctgaagtaaagatgccttgctgggaaaaaaaaaa

SEQ ID NO: 249 - DNA, 2908 bp, Homo sapiens
  CDS (382)..(1995)
ggggtgaacaggtcacttggatgtctcaaatggcgcagggactcggataccttacctagtgccattacagtactggagactgccagctagatccatcacacccaagtgaagctgtggaaaagcccttaaactccagagccagaaccagcaacctcagctccagaatacacttgcaaggcactggaagatctaaaattcctctttaaacaaaaagataagtaatgccccaccaacatcttttcacctcaaagtaaggtgatcccaatactagaaattttactggcaattgctctgattgttatcactattttaaccctaacttgtacaccaccaggagttccattggcagctcgttttgtgaccagtttctcttaggtcaccatgggcctgctcctgctggttctcattctcacgccttcactagcagcctaccgccatcctgatttcccgttattggaaaaagctcagcaactgctccaaagtacaggatccccttactccaccaattgctggttatgtactagctcttccactgaaacaccagggacagcttatccagcctcgcccagagaatggacaagcatagaggcggaattacatatttcctatcgatgggaccctaatctgaaaggactgatgaggcctgcaaatagtcttctttcaacagtaaagcaagatttccctgatatccgccagaaacctcccattttcggacccatctttactaatatcaacctaatgggaatagcccctatttgtgttatggccaaaaggaaaaatggaacaaatgtaggcactcttccaagtacagtctgtaatgttactttcactgtagattctaaccaacagacttaccaaacatacacccacaaccaattccgccatcaaccaagattccccaaacctccaaatattacttttcctcagggaactttgctagataaatccagccggttttgccagggacgcccaagctcatgcagtactcgaaacttctggttccggcctgctgattataaccaatgtctgcaaatttccaacctcagctctacagcggaatgggttctattggaccaaactcgaaattctcttttttgggaaaataaaaccaagggagctaaccagagccaaacaccctgcgtccaagtcttagcaggcatgactatagccaccagctacctgggcatatcagcagtctcagaattttttggaacctccctcacccccttatttcatttccatatctctacatgccttaaaactcaaggagccttttatatttgtggccagtcgattcaccaatgcctccccagtaactggactggaacttgtaccataggctatgtaaccccagacatcttcatagcccctggcaatctctctcttccaataccaatctatgggaattccccgttgcccagggtgaggagggcaatccatttcattccccttctcgcgggactcggcattctagctggtacgggaaccggaattgctggaatcacaaaagcttccctcacctatagccagctctcaaaggaaatagccaacaacattgacaccatggctaaagccttaacgaccatgcaagaacaaatcgactctttagcagccgtagtccttcaaaatcgtcgaggactagacatgttaacggcagcacagggaggaatttgtttggccttagatgaaaaatgttgcttttgggtaaatcaatcaggaaaagtacaagacaacatcagacaactcctaaatcaagcctccagtttacgggaacgagccactcagggttggttaaattgggaaggaacttggaaatggttctcttgggttcttccccttacaggcccacttgttagtctcctacttttgctcctttttggtccatgtctcctaaatctaataacccaatttgtctcctctcgccttcaggccataaagctccagacgaatctcagtgcaggacgccatcctcgcaatattcaagagtcacccttctaaggaggacccctagactgctcgctagtggaacacgacagaggcgaaatcctgccccgtctcccgtggacctggctggatatggtttttgccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaactatggcctcccaatagataggaacacacctgaagctggtgatcagccacttcctgactaggatctcaggagctgggtgcgcaggctcaagcatgcaccctaagaggcaaactagtggcatttacctcatatatgaccttccttaggcacggcttgactggcagcggaaaaactcctccagtgatcacgtgccgacttcagtaaaaccgctggccattgctccctcccaagtgctgggcaggccctgtgcctgcgacagacgcccgaagaaactccgaggcggcgcacgtgaaccccggggccacggccatgggtaaaacccaagtaagggccacagcgcatggggcctacaaagtacccgcgagccccaaaaggggacaggacacatgagtatgcgctaaaactaaaccggagaaaaatgctgtggaacaagaccaaaagcgcgacaaatagcacctcgggacaacaccgtgcgacacgaaagtaagagaaaccacacagtagcaacaaacgcgtgatgaa

SEQ ID NO: 250 - DNA, 3981 bp, Homo sapiens
  CDS (297)..(1118)
cggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacggttccatcctggccatcgccctgctgatcctgttcctgctcctagccctggctctcctctggtggttctggcccctctgctgcactgtgattatcaaggaggtccctccaccccctgccgaggagagtgaggaagaagatgatgatggtctgcctaagaaaaagtggccaacggtagacgcctcttattatggtgggagaggcgttggaggcattaaaagaatggaggttcgttggggagaaaagggctccacagaagaaggtgctaagttggaaaaggcaaagaatgcaagagtcaagatgccggagcaggaatatgaattccctgagccgcgaaatctcaacaacaatatgcgtcggccttcttccccccggaagtggtactctccaatcaagggaaaactcgatgccttgtgggtcctactgaggaaaggatatgatcgtgtgtctgtgatgcgtccacagccaggagacacggggcgctgcatcaacttcaccagggtcaagaacaaccagccagccaagtacccactcaacaacgcctaccacacctcctcgccgcctcctgcccccatctacactcccccacctcctgcaccccactgccctcccccgccccccagcgcccctacccctcccatcccgtccccaccttccacccttccccctcctccccaggctccacctcccaacagggcacctcctccctcccgccctcctccaaggccttctgtctagagcccaaagttcctgctctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaatatctcagccacctgcagtgacattgctggacccctgaaaaccattccataggagaatgggttccccaggctcacagtgtagagacattgagcccatcacaactgttttgactgctggcagtctaaaacagtccacccaccccatggcactgccgcgtgattcccgcggccattcagaagttcaagccgagatgctgacgttgctgagcaacgagatggtgagcatcagtgcaaatgcaccattcagcacatcagtcatatgcccagtgcagttacaagatgttgtttcggcaaagcattttgatggaatagggaactgcaaatgtatgatgattttgaaaaggctcagcaggatttgttcttaaaccgactcagtgtgtcatccccggttatttagaattacagttaagaaggagaaacttctataagactgtatgaacaaggtgatatcttcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgtttttttttttattaaagccaaatttgtgttgtatatattcgtattccatgtgttagatggaagcatttcctatccagtgtgaataaaaagaacagttgtagtaaattattataaaaaaaaaaagaaaaaaaaa

SEQ ID NO: 251 - DNA, 1104 bp, Homo sapiens
  CDS (281)..(649)
acgccaagcttggcacgagggcaggagaggggacctagatgggcaggcagccctgcaccgtctccttggagtccagccacagggcggagccggtggggtcggacccacagaacgaccgacggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcactctcatcatactctctactacacataagacacgaaaacgtacaacacaccaacccacaacggcaccccgcctcaacatattccctgcagaggggcaacaaccctcacgcaccgtcacaacaccatcctgcatacacaactgcgtccacccaatgccaccgacatcacacgagtaagcacttgacaccctccacacccgcgctgaacgtgcacacagcacaaagctgaacttggcgaacgacactacacagagctgcaccaatctcacaccactcacacacaaatctaaaggaata

SEQ ID NO: 252 - DNA, 1181 bp, Homo sapiens
  CDS (148)..(726)
ctgcctttcaggtagtaggcagtgcaggaaggggcaggtttactgctgaacgtaaaaggggctgggctccaaagatggtcggtcaaccagcgtactcctgtgccgagcaggaggttcctgggcactggcattctgtagaagagtgggatgtggactttgttgtgccctgatcggggcccctttggctggtccttaaccctgctttcattgctgtctttcagggtaaaggcagcagtaatgctaacgctagcaagtaaactgaagcgtgacgatggtctcaaagggtcccggacggcagccacagcgtccgactcgactcggagggtttctgtgagagacaaattgcttgttaaagaggttgcagaacttgaagctaatttaccttatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgaaaaaaaaaaaaaaaaaa

SEQ ID NO: 253 - DNA, 768 bp, Homo sapiens
  CDS (105)..(230)
attagcatgattccaatattaaaaaaaatggaccagaggagattctctctcctgtcctatcctcagcacccagttcccctccccacaggcctctcaggtgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctcatgggtcacagcagcagatgtgggctggagatctattcatttggttttggcttgaattttctgaatggtttacttgatcttgggaaagatatatcttgccaggaaaaatgataggccttgacaatgttgaatgatcctgcaccaccttgaaagacattttctaatatggtttgtcaggcaaagtggttagtagtcatttgtggcctgaggtagaagtcctcagaaatcagcagacttcactgataaaatgctgacttgcccctggactgggctctgtgagagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaacgaaatcgtcg

SEQ ID NO: 254 - DNA, 1251 bp, Homo sapiens
  CDS (1)..(1248)
atggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctgtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcaggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatga

SEQ ID NO: 255 - DNA, 1356 bp, Homo sapiens
  CDS (1)..(1353)
atggagtcctcacccatcccccagtcatcagggaactcttccactttggggagggtccctcaaaccccaggtccctctactgccagtggggtcccggaggtggggctacgggatgttgcttcggaatctgtggccctcttcttcatgctcctgctggacttgactgctgtggctggcaatgccgctgtgatggccgtgatcgccaagacgcctgccctccgaaaatttgtcttcgtcttccacctctgcctggtggacctgctggctgccctgaccctcatgcccctggccatgctctccagctctgccctctttgaccacgccctctttggggaggtggcctgccgcctctacttgtttctgagcgtgtgctttgtcagcctggccatcctctcggtgtcagccatcaatgtggagcgctactattacgtagtccaccccatgcgctacgaggtgcgcatgacgctggggctggtggcctctgtgctggtgggtgtgtgggtgaaggccttggccatggcttctgtgccagtgttgggaagggtctcctgggaggaaggagctcccagtgtccccccaggctgttcactccagtggagccacagtgcctactgccagctttttgtggtggtctttgctgtcctttactttctgttgcccctgctcctcatacttgtggtctactgcagcatgttccgagtggcccgcgtggctgccatgcagcacgggccgctgcccacgtggatggagacaccccggcaacgctccgaatctctcagcagccgctccacgatggtcaccagctcaggggccccccagaccaccccacaccggacgtttgggggagggaaagcagcagtggttctcctggctgtggggggacagttcctgctctgttggttgccctacttctctttccacctctatgttgccctgagtgctcagcccatttcaactgggcaggtggagagtgtggtcacctggattggctacttttgcttcacttccaaccctttcttctatggatgtctcaaccggcagatccggggggagctcagcaagcagtttgtctgcttcttcaagccagctccagaggaggagctgaggctgcctagccgggagggctccattgaggagaacttcctgcagttccttcaggggactggctgtccttctgagtcctgggtttcccgacccctacccagccccaagcaggagccacctgctgttgactttcgaatcccaggccagatagctgaggagacctctgagttcctggagcagcaactcaccagcgacatcatcatgtcagacagctacctccgtcctgccgcctcaccccggctggagtcatga

SEQ ID NO: 256 - DNA, 2299 bp, Homo sapiens
  CDS (314)..(2260)
actgctaggcgaggagagggaagggggcggaggagacagggctactgcaggcgcagagctgggggcagccgggggcccgagtggctgaggctggtcccgcagcggccgcttgccggcgttctggctcctgtggcctcaccaggaagcgtcagagtcccgacactggggaagctcggagcgccgcctccgctgccgccgcctcctgcctggctctgggtccccgagccccctcccctggcccagcccgactccctcctccttcccgaaccatccggctcgggctccttccctggcgatggctggccgctgagccatggctcagtacggccaccccagtccgctcggcatggctgcgagagaggagctgtacagcaaagtcaccccccggaggaaccgccaacagcgccccggcaccatcaagcatggatcggcgctggacgtgctcctctccatggggttccccagagcccgcgcacaaaaagccttggcatccacgggaggaagaagtgttcaggcagcatgtgactggttattctcccatgtcggtgaccccttcctggatgaccccctgccccgggagtacgtcctctacctccgtcccaccggccccttagcacagaagctttccgacttttggcagcagtcgaagcagatctgcgggaagaacaaggcacacaacatcttcccccacatcacactctgccagttctttatgtgcgaggacagcaaggtggatgccctgggggaagccctgcagaccacggtcagtcgctggaaatgtaagttctcggccccgctgcccctggagctctatacgtcgtccaacttcatcggcctctttgtaaaggaagacagtgcggaggtcctcaagaagtttgctgctgactttgctgcagaggctgcatccaaaaccgaagtgcatgtggaacctcataagaagcagctacatgtgaccctggcttaccacttccaagccagccacctacccaccctagagaaactggcccagaacattgacgtcaagctagggtgtgactgggtggctaccatattttctcgggatatccgatttgctaaccatgagacattacaggtcatctacccctataccccacaaaatgacgatgagctggagctggtccccggggacttcatcttcatgtctccaatggagcagaccagcaccagcgagggttggatctatggcacgtccttaaccaccggctgctctggactcctgcctgagaattacattaccaaggctgatgaatgcagcacctggatatttcatggttcttattcaatcttaaatacatcgtcatccaactctctcacgtttggggatggagtattggagaggcggccttatgaggaccaggggctcggggagacgactcctcttactatcatctgccagcccatgcagccgctgagggtcaacagccagcccggcccccagaagcgatgcctttttgtgtgtcggcatggtgagaggatggatgttgtgtttgggaagtactggctgtcccagtgcttcgatgccaaaggccgctacatacgcaccaacctgaacatgcctcatagtttacctcagcggagtggtggtttccgagattacgagaaagatgctcccatcactgtgtttggatgcatgcaagcaagactagtgggtgaagccttattagagagcaataccattatcgatcatgtctattgctccccgtcccttcgctgcgttcagactgcacacaatatcttgaaaggtttacaacaagaaaatcacttgaagatccgtgtagagcccggcttatttgagtggacaaaatgggttgctgggagcacattacctgcatggatacctccatcagagttagctgcagccaacctgagtgttgatacaacctacagacctcacattccaatcagcaaattagttgtttcagaatcctatgatacttatatcagtagaagtttccaagtaacaaaagaaataataagtgaatgtaaaagtaaaggaaataacatcctgattgtggcccacgcatcttcccttgaagcgtgtacctgccaacttcagggcctgtcacctcagaactccaaggacttcgtacaaatggtccgaaagatcccatatctgggattttgttcctgtgaagaattaggagaaactggaatatggcagctgacagatccaccaatccttcctcttacccatggaccaactgggggcttcaactggagagagaccttgcttcaagaataaaccacaccagtgaacaagaaggaaaaaaaaaaaaaa

SEQ ID NO: 257 - DNA, 1467 bp, Homo sapiens
  CDS (60)..(851)
atcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccattactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactt

SEQ ID NO: 258 - DNA, 2103 bp, Homo sapiens
  CDS (1184)..(1303)
agtggccagagcgactcttcagggaggtggcaggaaaggcttggaacagctgccggaggtgacggagcggcggccccgcccggtgcgctggaggtcgaagcttccaggtagcggcccgcagagcctgacccaggctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtgactttgcctctaccttccggctgctcacagtgtttgcttatgggacatacgctgactacttagctgaagcccggaatcttcctccactaacagaggctcagaagaataagcttcgacacctctcagttgtcaccctggctgctaaagtaaagtgtatcccatatgcagtgttgctggaggctcttgccctgcgtaatgtgcggcagctggaagaccttgtgattgaggctgtgtatgctgacgtgcttcgtggctccctggaccagcgcaaccagcggctcgaggttgactacagcatcgggcgggacatccagcgccaggacctcagtgccattgcccgaaccctgcaggaatggtgtgtgggctgtgaggtcgtgctgtcaggcattgaggagcaggtgagccgtgccaaccaacacaaggagcagcagctgggcctgaagcagcagattgagagtgaggttgccaaccttaaaaaaaccattaaagttacgacggcagcagcagccgcagccacatctcaggaccctgagcaacacctgactgagctgagggaaccagctcctggcaccaaccagcgccagcccagcaagaaagcctcaaagggcaaggggctccgagggagcgccaagatttggtccaagtcgaattgaaagaactgtcgtttcctccctggggatgtggggtcccagctgcctgcctgcctcttaggagtcctcagagagccttctgtgcccctggccagctgataatcctaggttcatgacccttcacctcccctaaccccaaacatagatcacaccttctctagggaggagtcaaatgtaggtcatgtttttgttggtactttctgttttttgtgacttcatgtgttccattgctccccgctgccatgctctctcccttgtttccttaagagctcagcatctgtccctgttcattacatgtcattgagtaggtgggtagccctgatgggggtcgctctgtctggagcataacccacaggcgttttttctgccaccccatccctgcatgcctgatccccagttcctataccctacccctgacctattgagcagcctctgaagagccatagggcccccacctttactcacaccctgagaattctgggagccagtctgccatgccaggagtcactggacatgttcatcctagaatcctgtcacactacagtcatttcttttcctctctctggcccttgggtcctgggaatgctgctgcttcaaccccagagcctaagaatggcagccgtttcttaacatgttgagagatgattctttcttggccctggccatctcgggaagcttgatggcaatcctggaagggtttaatctccttttgtgagtttggtggggaagggaagggtatatagattgtattaaaaaaaaaaaggtatatatgcatatatctatatataataggagcaaattattcttgagaattctccaaacacaggacaaacaaaaatgtgtgggcgccgcgccccaaaaggtcgcaaccatccggggggccgggcccacggtgagacatggccaagggtctaggaaactggcagcatgggtgttccccaacaacccggggacgagctgaccccgggctgcgccgggtcacggcagcccacacaccgcggcgcaagacgagcacgaagcccgacagacggagcaaccacctcagcagagacacagaacgaatagggacgagcaaaaaagcagacgaacaagaacaaaata

SEQ ID NO: 259 - DNA, 845 bp, Homo sapiens
  CDS (50)..(379)
gcacgagggagagtactgagaagcgtcggggagcgcaggcccaacagccatggcggtggaaggaggaatgaagtgtgtcaagtttttgctctacgttctcctgctggccttctgcgcctgtgcagtgggattgatcgccattggtgtagcggttcaggttgtcttgaagcaggccattacccatgagactactgctggctcgctgttgcctgtggtcatcattgcagtgggtgccttcctcttcctggtggcctttgtgggctgctgtggggcctgcaaggagaactactgtctcatgattacatttgccatcttcctgtctcttatcatgcttgtggaggtggctgtggcattgctggctatgtgtttagagaccaggtgaagtcagagtttaataaaagcttccagcagcagatgcagaattaccttaaagacaacaaaacagccactattttggacaaattgcagaaagaaaataactgctgtggagcttctaactacacagactgggaaaacatccccggcatggccaaggacagagtccccgattcttgctgcatcaacataactgtgggctgtgggaatgatttcaaggaatccactatccatacccagggctgcgtggagactatagcaatatggctaaggaagaacatactgctggtggctgcagcggccctgggcattgcttttgtggaggtcttgggaattatcttctcctgctgtctggtgaagagtattcgaagtggctatgaagtaatgtaggggtggggggcgtttggtcttttcatggagtggattctccaggtttttcaattaaacggattattttttcagacctaaaa

SEQ ID NO: 260 - DNA, 3725 bp, Homo sapiens
  CDS (718)..(2778)
agacaatgagggagagtctccgccgaccgcctgctgcttattgttccgggactggagactgcagccggctgctgcctagtcctccggggctccgctcctgactagctcctccgtccctctagggacggttcggggtcacctaaccctggtccccggggcgctgggacgctagccccaagccgcagccgctcttcgctgaccgccctctttctgctttgcaggtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccgagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcagcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgcccccctacggtacaggctgaggtacacggttagcaaaaccatgggaaggggaatagcggtgcatatcattaactaacactccaaacaaaggtgagcttgcccaggacttggcatttccaaatcaaagtttttagatatgaacacctactgtgagttctgctacaaggcacaaatgaatttgtctcaactatgcaatttgattggaaaaatgtatgtgcagcatgttacatttactttcacggaataaagcagatatgtttctg

SEQ ID NO: 261 - DNA, 2117 bp, Homo sapiens
  CDS (182)..(1249)
tgtcgttgttctgagggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagagcttgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaacatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgc

SEQ ID NO: 262 - DNA, 4087 bp, Homo sapiens
  CDS (539)..(3130)
tttcgtggtgccagccctggtggttgtgttctatgaactggactgggatgagcctcagtggaaagaaaagcagtctgagtgcgccaccagagtggaaatagtcaggcaaagtttacaaggaagaaacacaaaagttgcagtggttctgattcagaagaaaacccctttgcccccaggagaagatgtcattgcttcagaaagggctgcagctttatgcaatgcatgtgaactctcaggaaagtctttgtttgtactgccgcacactgaccaccttgtgggttatattataagattggaaaatgccttttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcagagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaaaaaaaaaaa

SEQ ID NO: 263 - DNA, 970 bp, Homo sapiens
  CDS (205)..(885)
ggtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctttccatgccagccacggcttcatgtggtacacgtaggccctgtgccctccggccacctggatccctgcccctccccactgggacggaataaatgctttgcagacctggaaaaaaaaaa

SEQ ID NO: 264 - DNA, 1980 bp, Homo sapiens
  CDS (1)..(1350)
atggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgctgttcgtggtgccgctgggcctgcgctcctgtcgcagcacacctgctccatcggctggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagcagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaa

SEQ ID NO: 265 - DNA, 2052 bp, Homo sapiens
  CDS (1)..(1422)
atggcgacccaggcgaagcgtccacgggtggcggggcccgtggacggcggcgacctggatcctgtggcctgcttcctgagctggtgccggcgggtggggctggagctgagtcccaaggtgagcgagcgagccggcgggcggaggacccgcggcggggcgcgggctgccctgaccagccctcctgctcaggtggcggtcagccggcagggcacggtggccggctacggcatggtggcccgggagagcgtgcaggccggagagctgctgttcgtggtgccgctgggcctgcgctcctgtcgcagcacacctgctccatcggctggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagcagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggaactgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagctgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaa

SEQ ID NO: 266 - DNA, 1342 bp, Homo sapiens
  CDS (1)..(786)
  misc_feature (1)...(1342): n = a,t,c or g
atggaagccgatgggcccgcgagcctccaggagctgcctccctcgccacggtcgccttcaccgccgccgtcgccgccaccactgccctcgccgccgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggcatcaacatttatgagccagcaccccctactggtcccacccagcgacccctggaaactctgggcaatttccgtggctggtacattagaactgaaaagctccagcagaaccaaagctggacagtgaagcagcagtgtgtggaccttctggccgagggcctgtgggaggagctgctggatgacgaacaaccagccattacggtcatggactggttcgaggacagccggctggatgcgtgcgtctatgagctgcatgtctggctgctggcggccgaccgccgcacggtcattgctcagcaccacgtggccccccgaacttctgggagaggaccccctggccgctgggtccaggtgtcccacgtattccgccattatggtcccggtgtgcgctttatccacttcctgcacaaggccaagaaccgcatggagcctggtgggctgcggcggacacgggtgaccgactcctccgtgtctgtgcagctccgggagtgactggctggctcctctgtcctgaccccacagcacctccctgacctttaggagccccaactcttagtcacctcctaggcctcttatttctccctggcccttggcttctcacttgatggacagcttcacacacccttaagcggtggactccagcattttcccagcactgtctgagccccatgagggcggagccactccttgtaaattcagtgcccgacagatgctctggcacagatgctttgtagatctctgttgagagaatgcatagacacctgtgcccaaggatgctgagggctggtctctgcttctttgaacttcactgaaactgaatgctcactgctgtgttgccagcaccacccagcccagggctgtgaacggagtgggtggcagcaaatgtgtgttgaaaggggaatgaagccattcacttcactcagttcctgtcccatttaaccgccccgatccttgatcttccattaccttcacatcccggggtccttctgaactgaccttgacctctgatctcttcacacatctcnccttagcatctcctgcctcc

SEQ ID NO: 267 - DNA, 3083 bp, Homo sapiens
  CDS (179)..(1516)
gacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactaaaaaaaaaaa

SEQ ID NO: 268 - DNA, 917 bp, Homo sapiens
  CDS (8)..(676)
ggccattatggccagggagtgtgaaatcttcagagaagaatttctctttagttctttgcaagaaggtagagatagagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttggctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggacttcggtgtgacatgaagactggtgatcacatgccaggctggtgagcagggaaaggaaaagggacacgttacggttcatacaaccttacacagagtttccaacttgcgagggtcagaatacagagagctatgaaaagttggcgaggaggaagaaagccattggatgcacacacttgagctcaccaaggggccacagagagaccaataaaaaatacgaagattgtgtttctcgctctctattaacatacacttgg

SEQ ID NO: 269 - DNA, 1432 bp, Homo sapiens
  CDS (93)..(1004)
ggccattatggccggggcagtgtgaaatcttcagagaagaatttctctttagttctttgcaagaaggtagagatagagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatgggtttcccgttctgaaattgacatgaatgatatcaaagcattctatcagaagatgtatggtatctcccttttgccaagcccatcctgggatgaaaccaaaggagattttgaaggaaaatcctggtggctctttgtggagcgaaactaaacattcccttgatggtctcaagctatgatcagaagactttaattatatattttcatcctaattaagcttaaataggaaagtttcttcaaacaggattacagtgtagctacctacatgctgaaaaatataggctttaaatcattttttatattataaactctgtataatagagattagtcccatttttttaaaaaatgttttccccaaaccataaaaccctatacaagttgttctagtaacaatacatgagaaagatgtctatgtagctgaaaataaaatgacgtcacaagac

SEQ ID NO: 270 - DNA, 1211 bp, Homo sapiens
  CDS (184)..(768)
gagctgagccatgtacttcaaacagaaggcagccaattactaacttctggttgctaggtgtggcttcctttaaaatcctataaaatcagaagcccaagtctccactgccagtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaaatgaagaacttgggctgattcaggatgccaagggccttgttatgaaagcaaggagaaaggggaaaggggacaagacgtaaaacgtgttcaataccatctttacacagaagtatcccgaattttcgaatgtttctcaaaatccccgtacagtacctttgtagataacacttttgaccggataaaggggacttagaaagtaactgccactattgtggaggggcgccaaaaaaaaactttttttgtggagagaatataccagcaaaggtgggttcccccacagtatgggacagaggtgcagctgcgaagaagatacacaaacaagatatagactcccacgccgacagaaaaaaggcaatggagcgaagaacacgacagacacataatatcaggtgtcatcttgtgtgtactttcctcttctcatatcttacaacataagcatgaagc

SEQ ID NO: 271 - DNA, 2603 bp, Homo sapiens
  CDS (120)..(2048)
cttgagctttaaactgaagagtttcgcttacagcctcaccactggcatccatgtgatatcgtttggctttttcttgtaatacagcatcaaaagtctcctgtgtaattcgtctggctgccatgttattttgccccgccgccgccgccgcgcgaggcggggacatgcaaatgaaccaacggtctccgcagcgccgcgccgcgcaggcgcaagccgccgccgagtcctggtgcgcaggcgcgggccgccgcggcccggctctcttgcgcaagcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaaaaaaaaaaa

SEQ ID NO: 272 - DNA, 1363 bp, Homo sapiens
  CDS (418)..(693)
acggatatactcttctaagaagagcttcttgaggtcagggatcatgtcttttgtttttgcgtgcccagacctaggtcttagaagacgcctaataaacatcagttgaaaaaaatgactggatgatctttcactttttccacgcagaaaacacgtggcgacatcactgagaaacctcccggccaacagagggcgcgacgtccatttcagcgcagtggggcccagttgcggacgcctagcttccttccgtcctttggctgaagttcagccaatccctgcactccgagagagccggcggccagggggcagggtcacagggcaaggtcccgcgggccgctgggtgcggcgacttccgtgctcccggcgagcgggcggagagcgggggccgcactggggagtgtgggctgggccgcagatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatccctgtatagtgaaaaacctgattaaagtggtatctgagaaccataaaaaaaaaaaaaa

SEQ ID NO: 273 - DNA, 1568 bp, Homo sapiens
  CDS (108)..(1565)
ccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatgatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctga

SEQ ID NO: 274 - DNA, 1464 bp, Homo sapiens
  CDS (108)..(1091)
ccagggtggacgcatgccctcaggtgcgggcgtcttgcgagtcggcctcgcagctctgtggaagccgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatgatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaaaaaaaaaaaaaaaaa

SEQ ID NO: 275 - DNA, 1765 bp, Homo sapiens
  CDS (359)..(1762)
cagtggtaacaacgcagagtacgcggggagatattaactcagccactacaagtcaaggcaaacaggccagggccagggcagacaagaggacagacaagaggacagacatctgcagcctgtggcctcctgtcaccctcccacccaccatggaaatgccctggcccctagggtggattctgcttcttttgggaagccccctcatccacgctgagcctcttctactggcaggtacatcctggtgaccccccgagttctgagggttggcagtccggagagcattcacattcaggcccactcagactccagacagcccctcacaaggaccctcaaggtgaacctcacagtgtgggacttccccatgaggaagacagtgttggcaaggagccagctcattctctcaccaggaaacaactttatggaccaggcacctgtgacggttcccgagagcctggtgtacctcccaaaaccagggcagcaatatgtcatcatccgggcaacttgggcacccacctcgggctcctcattcatggagaagatggtgctggtggctcttcatgctggctacatctttatccagacggagaagaccatctacacccctgagtacttggttcactaccgggtgttcactgtgaaccacaagatggaccctgtgaccaggacattcactctggacatcaaggtggtctttcccgatgagggtttggggacctggaccatcgaagccagctaccaaagtacacccaagcagaagttcgaggctgcctttgatgtgaaggaatatggtgagaaagtcctcccatcttttgaggtccagctggtcccaaataagactttcttttacctcaaggatgaggctctgggcgttgacatccaggctcgtggtgttgtactgcatctcatctcatctgccacttcacagtttagaccatctctgaaagtctatgaggtagtacaggttatgtttgccatcatgagattgtccagaccatctctgcagctctatgtgatgaccatctgcattgctatgaggttgtgcaggcaatgctgtccacctgagattgtatgggctatgtctgccacttctggacattatatgaatcattcctgcagctctaacatgctacacaggccacctagtttccctgaacagatctctgaaggcctgggccacgtctccctccagaaggacacgctcatggccgcattccaaggcccaggagaggacttcattggaggctcaatctttgtcaatgtcaccatgttctcctcagggggtgagatggtgcaagctgagacctcaggggtgaagatcatccagagcccatacaacatcaagttcaccaggacaccccagtatttcaagccaggaatgcccttccactttcggattccacctcaggtcttcatctcaaatcctgatgggtccccagcttccagagtccttgtccactcccaagaccaaaaagtgtacacctcagctgaggggttggccactctgaccatcaacacagatgcaaatctggacaagctccccatcgaggtgaaaactgaggaatctcttcagccagaggagcaggcttcagccaagatgacagcttggccttacttgactcaggatgggtcaggaaacttcctacacatcgaagtaaagacattgggcacagaggttggcagcagcatccagctgagcctcaacacaaggcatcaggaccctaaaaccaaggacaagattactcacttcaccatcctggtgaggagctag

SEQ ID NO: 276 - DNA, 1341 bp, Homo sapiens
  CDS (34)..(1182)
ggaatactgggtcgacccacgcgtccggacgaaatggacatgacttgggagaagcggcttgctttcggcggcggcggcggcggcggcggtggtggttgtggcgaggctgtgcggcagggcgcacgggacctgtcctgcagcggctctctcaggccgtgggtcgtcgctgcagctgccgggaaagaaggaaacgacgactccgggggcgaacttggcacacagggaggaagggaaaggatgcatggtcatggaggctatgattctgattttagtgatgatgaacactgtggagaatccagcaaaaggaaaaaaaggacagttgaagacgacttactgctccaaaaaccatttcagaaagaaaaacatggaaaggtggcccataaacaagttgcagcagaattgctggatagggaagaagcaagaaatagaaggtttcatctcatagctatggatgcttatcaaagacatagaaagttcgtaaatgactatattttatactatggtggcaaaaaagaagacttcaagcgtttgggggaaaatgacaagacagacttggatgttatacgagaaaatcatagattcctatggaatgaggaggacgaaatggacatgacttgggagaagagacttgctaagaaatactatgataaattatttaaggaatactgcatagcagatctcagtaaatataaagaaaataagtttggatttaggtggcgagtagaaaaagaagtaatttcaggaaaaggtcaatttttctgtggaaataaatattgtgataaaaaagaaggcttaaagagttgggaagttaattttggttatattgagcatggtgagaagagaaatgcacttgttaaattaaggttatgccaagaatgttccattaaattaaatttccatcacaggagaaaagaaatcaagtcaaaaaaaagaaaagataaaaccaaaaaagactgtgaagagtcatcacataaaaaatccagattatcttctgcagaagaggcctccaagaaaaaagataaaggacattcatcttcaaagaaatctgaagattctctacttagaaactctgatgaggaagaaagtgcttcagaatctgaactttggaagggtccactaccagagacagatgaaaaatcacaggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaaaaaaaaaaa

SEQ ID NO: 277 - DNA, 450 bp, Homo sapiens
  CDS (55)..(429)
cccacgcgtccgatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagagtgagtgtgcctcggtctcccgcgccccagcccagcccctcaccctgctcttccttgcaaacccactcctccaccccccaccccgccgttgtccccggtgtgggcggccccggccactctttcagtttcacaaagcgccttgtttctccccagccccaagcttccttctaaatccccacacctcgtgggtgcctcgcccacaccgggaagcacctcggttgcgggtgggggttgcagctcccctccagcgcccgcttcccgctctccacagccattgagcaggagaagcggagtga

SEQ ID NO: 278 - DNA, 1144 bp, Homo sapiens
  CDS (515)..(805)
agcgacagtgtggtttcggccgcagcagaaacgtgactgagaacgcatccccgcgatgacctgacccttctgctcagggctgggactgtccctaggagttgagcaggaacaggcatctgtggtttacagcgacctggctctccgcgggccacgtgggtggtgagggcacacgagtgggaagcggcaccgacgtgtttctccccgaccgtggctttgccaaagacttttaatagcattttttaagtgcaaaacgtctaggtaaaaatctttatcatcagtgaccaaattagaatgtatttaatatagtaggtggtttaagaactgttttaacgtaagacaaactgatagcaacattctgttgttttaaaggaagtgggtccgtgacattctgcagctagtccactactccaaggtaactatcgacttggtttcagtgaatctattttgtttttaactacagtgatttattagctcagtatctagaaattacgtatattttgtgctactgtcatcgatgtgtaaactctgtttttatttgtatttatgcacttggttcccatttggagcctctggtcttttctgggataagtggtgtctgccgagacatctcccggttgtcagtggtcaggagcagctgagctctagtctgccagctgctctgctctttctgggaaggaggtggcgcccgcccctcagggtgtctccagggctcagcttccggggtggtagagctggggagccccaggggtggggggacagctgggagatggaggtggcacctgctcccctagatcagtactggctctgaggacaggtgagcagtgggaagaccaaagaatggctggcagcgctgccagggttggaaatgggggcaagatcctggggctgtgtgccctggggcctccctcacctgtcttggtggccatggcctcagggatggctcctaggtggctgaggcacagcagtggctggaaggtgccccgtggaggctgaggtggaggcgcgcccagcagctcccccctgtggccatggcgggcacggggcgtaggagctggctggcggccggctctgcatgttcttgttgcctgtcgtctgtaactctagtgttcgacattcgccgtgatacagtggtgtcacgacgaaa

SEQ ID NO: 279 - DNA, 1739 bp, Homo sapiens
  CDS (106)..(1404)
atgctgatctcaaagggaaagcattcaacgtgtcaccattagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccacaaaaaaaaaaa

SEQ ID NO: 280 - DNA, 363 bp, Homo sapiens
  CDS (115)..(240)
cgcgacccaggcgcgggtttccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacttcttggagatgactactgggggctagatactggccaaacaccgatggttcaggaacatggtggtctggccttgtaggtacatatttgacctgtcaatgtttaagctctaggaaagcatgagcttaaaagagccggaccttgggtacttgatgatgtccttaacgcttttgcggattttcagatttaaatttgaccg

SEQ ID NO: 281 - DNA, 774 bp, Homo sapiens
  CDS (399)..(566)
gatattaatcgatttccctcaagcctgcccttgctgtgaactagtgctacaagcacgggaaatccatctgctctctggcttaaaatatgtatctcatctaaaattgttcgttaaagtgtgaataaattgctaagtggttgttgcttagcaataatttttgcctgaccatcagcagagcttttatttacctttgtaattaaaatccaacatagcatgggctcttgggcaaaatatttcactgactattaagcatgtagaacaggaaaatgaaatacactatttgtgcccttgacctagaaccagaaccactaattatgagaactttgttttatgtaccaaattcacattgaccattttctgagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggaattgaaataatgtgctcagaataataacatggttatagttcttgtatgataaagtattcaatttcagaataaaaaaaaaa

SEQ ID NO: 282 - DNA, 2568 bp, Homo sapiens
  CDS (16)..(1782)
cagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgacactggagaccaccattggcaacaagaacccagccctgtggaagtatgtgcggcccaggggctgtgtgctggagtgggtacgcaacatcgtggccaaccgcctggcctcggatggggccacctgggcagacatcttcaagaggttcaacagcggcacgtataacaaccagtggatgatcgtggactacaaggcgttcatcccgggtgggcccagccccgggagccgggtgcttaccatcctggagcagatccccggcatggtggtggtggctgacaagacctcggagctctaccagaagacctactgggccagctacaacataccgtccttcgagactgtgttcaatgccagtgggctgcaggccctagtggcccagtatggggactggttttcttatgacgggagcccccgggcccagatcttccggcggaaccagtcactggtacaagacatggactccatggtcaggctgatgaggtacaatgacttcctccatgaccctctgtcactgtgcaaagcctgcaacccccagcccaatggggagaatgctatctccgcccgctccgacctcaacccggccaatggctcctaccccttccaggccctgcgtcagcgctcccatgggggtatcgatgtgaaggtgaccagcatgtcactggccaggatcctgagcctgctggcggccagcggtcccacgtgggaccaggtgcccccgttccagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggcaaaaaaaaaaa

SEQ ID NO: 283 - DNA, 677 bp, Homo sapiens
  CDS (161)..(379)
cccacgcgtacgggtctcatcacatataaaatgtttgtagattctcaggattcttgtacacacctgggggggggtcttgatagtggagggggatgctcttaaagaactggacaagacatttaacctgccagttctggaagcactgctcagggatgtcaacatgcaggaataccccgatttatttcacatttataaaggctttgaacatgtaatccatgacgaattgcctctcccagaaagcgacgacgaagagagggtggagaggtctggcctcctactacgtcttgagctgggaactggtgaaaactcttttcgaagcctgacttggccaccttcgggttccccatctcatgctggtttgttcctgtttactactctttgagcctctgctattcttgcccctttctggaatgtgctgtggggttgcctctttgtgttaatgattgtccagaattttcaggttttacatctacagtttttccatttctgggatttaaataacaagtccttatcctctaggttgcctaggaggggttcttcctcccacaccccttaatcacacttggctgctgggttcctgctgccgctgagcctggtcgtttttcccaagtggcggcttcaccaatttctgtccgcatctgctttaaaaccgggggctgcccctggggcccctaact

SEQ ID NO: 284 - DNA, 1826 bp, Homo sapiens
  CDS (76)..(1347)
aactgatgcctccactggccactcctccctccgtccacctgtcacttcgggtagctgggaggccagttaaaaaaaatggaacctttttcctgtgacactttcgtggcattacctccagcaacagtcgataacaggattatttttggaaaaaattcagatagactctatgatgaagtacaagaggtggtttattttcctgctgtagttcatgataacctgggagaacgtcttaagtgtacatatatagaaattgatcaagttcctgaaacatatgctgttgtcctgagtcgcccagcgtggttgtggggggcagaaatgggagccaatgagcatggagtttgcattgggaatgaagctgtatggggaagagaagaagtttgtgatgaagaagcactattaggaatggaccttgtcagacttggccttgaaagagctgatacagctgaaaaagccctcaatgtcattgttgacttactagaaaaatatggccagggtggaaattgcacagagggtagaatggtatttagctatcacaacagtttcctgatagctgataggaatgaagcctggattctggagactgcagggaagtactgggcagcagaaaaagtacaagagggagttcgtaatatttctaatcaactttccataacaaccaagattgcccgggaacacccagacatgagaaactatgctaagcggaaaggttggtgggatggtaaaaaggagtttgattttgctgcagcatattcctatcttgacacagccaagatgatgacttcatcaggcagatactgtgagggctacaagcttctaaataagcacaaaggaaatataacttttgaaacaatgatggaaattcttcgagataaaccaagtggcattaatatggagggagaattcctgaccactgcaagcatggtttctattttacctcaagactccagccttccttgcattcacttctttacagggactcctgatcctgagagatctgtttttaagcctttcatatttgtgccacatatttcacaactattggataccagttcaccaacatttgaacttgaagatctagttaaaaagaaatcacattttaagcctgacagaagacacccactctaccaaaaacatcaacaggcattggaagtagtaaataataatgaggaaaaagccaaaataatgttggacaacatgaggaaactggagaaagaactattcagagagatggaatcaatccttcaaaacaagcatcttgatgtggagaaaattgttaatctctttcctcagtgtacaaaagatgaaattcaaatttatcagtcaaatttatcagtcaaagttagttcttagtgatcatatggtcagctaatattagttcttagtgatcagtggtcagtaatcttcaaagtcagaatctatcaccttggtaaattatataaacctaacttgagcagatctgattattcttggatagtattcaagtggtatcttgactattaaactacgtatagtgttgctgaaatagaaagaaaacagcattggaattggattcatgtatcgtgggatacaggtgttatttcaggtgatgtacttgcattattttctttagccatagtaactttttgtcacaataactaagtattcaattatatataaagagtgaaacattaaaatgacgcatggatttatatttattataattatgtagtaccctcaaatcattttgtcagttacatcaagaaagcagatttttctttagtcatgaaaaatatctcaagtggtaagttgtttgtgctttaggcaaacattaaccagctctaacaaga

SEQ ID NO: 285 - DNA, 408 bp, Homo sapiens
  CDS (117)..(284)
caaaaacaacctgcatgaccccatgtctgggggctggggggaaggaaaggatctgccacatgttctggtgcgagcccaatgctgccagcctctcataggctgtgcaggctgcgtgcatgcttcgctaccagaagtgtctggatgcccgttcccaggcctccacctcctgcctcccagaaccccctgctgagtctgtggcacggcgtgtagggtggactgtccgcaggggtgttcagtcgctgtggggctccctgaaacccaaacgggtgggggcccataccccatgaagaagcccccaccttccctccacctgcttgtgttgggccccagggaactaaagggtgtgggtcagggaggggtctagaggctattcctacgcctcaggcctcccaaatatgcccctcccca

SEQ ID NO: 286 - DNA, 566 bp, Homo sapiens
  CDS (257)..(424)
gcctccgggcgtgcgcctgtcccgggcgcccgccgctgcctccctctcttgcctctggggagtcccggcgggccgcgaccccagctccagctgccgctgagccgccgccgccgctacagcgaccctgaccgccgtccgagccgccagacacccagagagacgccagaggccgcggaggggcgaagacccgggtaactctcccttccaccccaacccggatcgccagccctcgagagctctgtgctccacgccgaggatgcaccgtctctggattggtccggccttcttcctaatgacatcgctcagcgtctctggagccgtcatcccgcggaatgggggcccagggggtgtcagctcggggccttgcctcttgcagctactctgtggtcaggccgggtcctccaccatcaggaagatcccatcctgagctctgtctcctgcccctcgtgctgtgggatgctgagcacagagcccacagcccatctgcctcttcacctccctgaatccgtgtccatctgcaataaacgacagcctcggctgcctcgtgctgtgtcaaaaaaaaaaaa

SEQ ID NO: 287 - DNA, 3604 bp, Homo sapiens
  CDS (544)..(3375)
cgccgcggaatttccgggtcgacgatttcgtgcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggctgttttgacagaatacaaattaaaagcaattgaatatgtgcatggatacttttctagtgaacaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtaaaaaaaaa

SEQ ID NO: 288 - DNA, 3469 bp, Homo sapiens
  CDS (91)..(3219)
gggagctcgctgccgaggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaa

SEQ ID NO: 289 - DNA, 1231 bp, Homo sapiens
  CDS (87)..(1022)
gagcgctggctctgctggcggctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaaggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaaaaaaaaaaa

SEQ ID NO: 290 - DNA, 2126 bp, Homo sapiens
  CDS (15)..(1277)
gactgtgagacagaatgaagttgggctgtcaagagaagccgctatccaggtatggagtccaactttgccccccaatgccaagggttcgctccacttatgccagtgtcctaaaggcccaaggtcggaacaaggaagcgatctgcccttacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgatatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaa

SEQ ID NO: 291 - DNA, 458 bp, Homo sapiens
  CDS (39)..(329)
gcacgagcctttccggtgagaccagattaactatctccatgtttgtccttttctacctcgttttttcaccactcccaaacataacctcccaatcttttttgttagtccggccgtcaatttgtatagtaccaatttctgtaaattctctcaattcattgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagt

SEQ ID NO: 292 - DNA, 714 bp, Homo sapiens
  CDS (297)..(605)
ggtgtcttaccaggtgctaatgtggctcttactacacacaaaacattgttctgagcgcctttcaaatacaaactcctttcatcttaagcaccacccgacagggcaggtactattaccatctccgtttgacagatgaggaacctggcacaggaagcatttaagtggattccccaggatcgccccactgtcaggagcagagtcagaatgggcctcagcatcaggctcccaatcctggcttctaactgctgcgctctgcccttctctctccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctccttataaaaatgtccctcagtgtctgctatgagccaggtgcagacttaagtgacagggctgctacgggaaataaaaaattatcaaggagcacctgcctcttaatgcacagtagcgaactatgataagtgtcaggaaggaaaggttaaggatgccaggaaggctcgtaatagtaggaagacgctagatggtcaggtggtctcgtacgtgtaaccgggtgcttgtgtcgac

SEQ ID NO: 293 - DNA, 3749 bp, Homo sapiens
  CDS (1)..(2865)
atgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcagaagttatgtggagcctcctctggcatcattgacctcttgccatcccctagcgctgccaccaactggactgcaggactgctggtggacagcagtgagatgatcttcaagtttgacggcaggcagggtgccaaaatccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgttgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcccggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcccccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagcaggttctcctatgctgactccaggttgcttcatacaaggagggtggttgaacttcacacacgtaaggtcttagtgcttaacagtttaaaggaaagtccttgttgaggcagaactaagtttacagggaaaggtacacacattctctctctctctctctctctctctgtctatctagttccccagcttggagagcctttccccttgcttctttctgaggccatataagcttataagaaaagtcccaaaccaagaataggtccttggccacaagcagggtctgatcccccatcagagctatctgagcctgcctgtctgggcacctgctgcaaccatgcagctaccctgccaggggcactcagcaaacagaaccacagggcccaggaggcattccacacaggcactgccccaggacaacacaacaaggacagtcacaacaaggacaacaaggacacaacacaacacacaacaagga

SEQ ID NO: 294 - DNA, 1453 bp, Homo sapiens
  CDS (438)..(998)
cccacgcgtccgcttttttgggcactctgccaggcagggtaggagaggtgcctggatggatagggcataattgggccagacagacacggttcttagccttttggagcttaaagtgtcttgagaaacgcagacaggatgtcatgtggcctgtgttttggaccgtggttcgtacctatgctccttatgtcacattccctgttgccttcgtggtcggggctgtgggttaccacctggaatggttcatcaggggaaaggacccccagcccgtggaggaggaaaagagcatctcagagcgccgggaggatcgcaagctggatgagcttctaggcaaggaccacacgcaggtggtgagccttaaggacaagctagaatttgccccgaaagctgtgctgaacagaaaccgcccagagaagaattaatggaggacacagggccctatggtcctactgtgggtggtgacttgtcctgctaccatgttgacagagccccagaacccacatctaattggctttgttgcttattctggcccttcccacaccacacagccacacaaatactggctgctccttgatggccaggcagacccagcagcagccgaggggccagtgaagaggaaggccgcatctgttgtgtggtggccacaagcactcaggcatctgagtttactggtgcactgctgggaggagagttatgagatgaacattggctgtcaatctctgtgggcaggcggtttggcctctagtgggaatggctgggatttgggcgttgcctttaggagggatacctgcatgtctagttccagtctgcactggaaagaattcaaatatgcacctggctcccttcactattttgccctatcctttgtgctcattcttactgaaatctgtcttgtcagctcaggaatgggattcccccaggaaggaaagcacttttctgttctgggaagcccagactgttcactttggggcagggacgaacatgtgcctcgtgaatttgcttgaaaacagtcaccatcttctacccccatcactgtatagtgaaaacacccctggatttaaaaggtgggtaatccctgaagcaaaccaataaccaaaaccaacagacggcaatcaacacgacacaccgcaaacatatgcacaaacagaaaacaacacgcgggggaacaccaattacgggcgtggcgcgaccaaaaaggcgacatgttctacaagtagggaaccacgtgggacatgaaggtgtccagcaagaagcccaatatttggtggtaaacaaagtggtggaaactatgggggggatccccacatcttgggtgcagctgactaatacatcaaccaaacacggggataaaaggcggtttattaaaatctcctaacaacattcgtactggcatcaaacaaaggaggaatcacaacgcttgcacgagaacaacagcagaaacagagcaactgagaga

SEQ ID NO: 295 - DNA, 2716 bp, Homo sapiens
  CDS (277)..(2442)
atcaatgaataagtaaatgagggaatggagaaaatttaaatctttgtggcaaatatcagtagcccaaagaaagaaaatatatgctagtttgaatagaaattatttttcctattatgtccaatttacagaaggatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacacaaaaaaaaaa

SEQ ID NO: 296 - DNA, 439 bp, Homo sapiens
  CDS (81)..(431)
gtcgggcggctccacagagcccttaggcctttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatgggtaagcgctgcacgcgagtccagggccgccctgcggcctccgggagccgacctcggggttgggaagggacgggcgtccgtcagaagcctcggaaagtgccctgcctgggagagtgggtggaggtcgccctgccccggcgccggaggaacgcggagccacgctcctgctgcggctcctgagggct

SEQ ID NO: 297 - DNA, 1632 bp, Homo sapiens
  CDS (107)..(973)
tttcgtggcgaacgaggccccacctctgccgggagcgggacgagcgcgcaggcgcagtctccccaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcacatggattatatggtgttatgaatgtgatgaaaaattatcaacgcattgtaataagaaggttttggctcagatagttgattttctccagaaacatgcttctaaaacacaaacaagtgcattttctagaatcatgaaactttgtgaagaaaaatgtgaaacagatgaaatacagaagggaggaaaatgcagaaatttatctgtaagaggaattacaaatttaggaaatacttgcttttttaatgcagtcatgcagaacttggcacagacttatactcttactgatctgatgaatgagatcaaagaaagtagtacaaaactcaagatttttccttcctcagactctcagctggacccattggtggtggaactttcaaggcctggaccactgacctcagccttgttcctgtttcttcacagcatgaaggagactgaaaaaggaccactttctcctaaagttctttttaatcagctttgtcagaagtgggtgcatctacatttaatataaataattatgagttacaaaatactaatgtattcatcatttaacatgaatagtcgtttttactgtaactttgctcttattgccctgactatgaagagaactaaaatttgttacagctctatgctttatgaaaattatatctcagtcctcagaagaagcagcttatcctcatatataaggaaatggagacacagaaattaaatggctcacctagtctgagtgaaaagctgagaatcaaatggagatctgtcctgacttggatgcctatgttgtaataccataaagtgagaaaaccatagagttgtaaaatctagaaagtaccgtaagataacatctaatctagctttcttattttaaaagatgagctgtgaggcaaatagagtttaagtgaatttctcaaggtattacagtatgtttaaaaaccaaatccttatgtgcctggaaataaacacataaaggatctgacttgactttaatgcattcatgtattcatttatataaaaaattgagagcttgctttttatgaggtacttgctacaattcaggggtacacaacatatattgcgccacaaatgcaccctgtcctcatggaactcacaagatagtccagtccacaattactaaaatatgtagaaggaaaaacgaaatcgtgacagcga

SEQ ID NO: 298 - DNA, 2118 bp, Homo sapiens
  CDS (324)..(1544)
ggtggagacagcggctgaaatggaagcatatgttctagaagacattcttgaggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggaataggaaaattgtccacggctgatggtaaagcctttgcagatcctgaagtacttcggaggttgacatcgtctgttagttgtgcgtttggatgaagctgctgctgcacttacccgtatgagagctgaaagcacagcaaatgcagggcagtcggacaaccgcagtttggcagaagcctgttcagaaggagatgtaaatgctgtgcgaaagttactcattgaagggcgaagtgtaaatgaacacacagaggaaggggagagcctccttcgtctagcttgttctgctggatactatgagcttgcacaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggcaatacagcacttacatatgcttgtgctggaggctatgtagatgttgtaaaggtgctcttggaatccggtgctagtattgaggaccataatgaaaatggtcatacccctcttatggaagctggaagtgctggacatgtggaagtagccagattgctgctagaaaatggggctggcattaatacgcattctaatgaatttaaagagagtgcccttaccttagcttgttacaaaggacacttagagatggtgcgatttcttttggaagcaggcgcggatcaagagcataaaacagatgaaatgcacactgctctgatggaggcttgcatggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggagctaacgttcatgcaacaacagcaacaggggatacagcactaacatatgcctgtgaaaatggtcatactagtatgtcgcagatgtcttacttcaggcagtgcgcagatctggaacatgaactctgagaggtggaagcaactcctttatatgaaagctgcaaggagctggtcatgttggtactgttcaggttcttaattagtaaaggagcgaactgtgaatagaaccaaggtaataatgacgcatactgtactgtaccctggcttgtgcagggggtcatctggcagtggtggaactacttttggctcatggggcagatcctactcagccgtttgaaagatggctcagctatagttggatagaagcagcaaaaggtggccatacaagtgtgatagctatctcttggattatcctaataacttgctttcaggcccctccgaccagatgtcgactccaggtttaagttccccccatccccaggcagtttacaataggggctccgcgatggttagccagctttcaaagcgattggcccaattgggtatgtatccaaccttcccagggagcccttgaagaaaagcatccttggcccaaattgttaggcgacccacttctttccccatgcaggagattaaaggacgccagctggaatgaagccatctctggcaagtgccaaagctcctaacccaacaggacttg

SEQ ID NO: 299 - DNA, 1533 bp, Homo sapiens
  CDS (619)..(795)
  misc_feature (1)...(1533): n = a,t,c or g
aagccccacgcgcgccccctgaannccttaactgaggaaatgncgcaaccacgannacgccaagcttggcacgaggagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgcaaaaaaaaaaa

SEQ ID NO: 300 - DNA, 942 bp, Homo sapiens
  CDS (52)..(807)
tcctccttgctgcctgccggccctctgtctgcaacgcctgctggcctctgcatgggcagaagtcctccagctctgcatcttccgaggcctcggaaacctgccagtccgttagcgagtgcagctcccccacctcggactggtccactggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaaactaacgcgccatgatccagaccaagcgccagacctccactgcgtgggctgccaccgggggatggccacgggcaatggcctagccctcggggcgcacccccccggaggtgagcaaacatccaggcagaacaacactccaacaagccacggtgcgcagcgcctgcaagcgcacggcccatcccaatactggacgcccatcggccctgtaagacgcacacggtgctgatacaacgggtaactggagcacacacgacgagaagtaggatggctataaaacacagaaaaccgatcccctagaccggatctgaagagccccaaaggaagatgcacaagcagggcgctacccagggccgcaccg

SEQ ID NO: 301 - DNA, 1824 bp, Homo sapiens
  CDS (29)..(1465)
ccgggtcccggagccggctgtctgagggatggacgagacgagcccactagtgtcccccgagcgggcccaacccccggactacaccttcccgtcgggctcgggcgctcactttccgcaggtgcccgggggcgcggtccgagtggcggcggcggccggctcgggcccctctccgccgggctcgccgggccacgaccgcgagcggcagccactgttggatcgggcccggggcgcggcggcccagggccagacccaaaccgtggcggcgcaggcccaggctctggccgctcaggccgcggcggcagcccacgccgctcaggcccaccgcgagcggaacgagttcccggaggatcctgagttcgaggcggtggtgcggcaggccgagctggccatcgagcgctgcatctttcccgagcgcatctaccagggctccagcggaagctacttcgtcaaggaccctcaggggaggatcattgctgtcttcaaacccaagaatgaagagccctatgggcatcttaatcctaagtggaccaagtggctgcagaagctgtgctgtccttgctgctttggccgtgactgccttgtccttaaccagggctatctctcagaagcaggggccagcctggtggaccaaaaactggaactcaacattgttccccgtacaaaggtagtatacctggccagtgagaccttcaactatagtgccattgaccgagtgaagtccaggggcaagcggcttgcactagagaaagtgccaaaagttggacagcggtttaaccgcatcgggctaccaccaaaggttggttcattccagctctttgttgaaggctacaaagatgcagactattggctgcggcgttttgaagcagaacctcttcctgagaacactaaccggcaactactgctccagtttgagcggttggtggtgctggattacatcatccgcaacactgatcgaggcaatgacaactggctgattaaatatgactgtccaatggatagttctagctctcgggacacagactgggtggtggtgaaggagcctgttatcaaggtggctgccatagacaatgggctggccttcccactgaagcatcctgactcctggagggcatatcctttttactgggcctggttgccccaggcgaaagtcccattttctcaggagatcaaagatctgatccttccaaagatatcggaccctaacttcgtcaaggacttggaagaggacctatatgaactcttcaagaaagatcctggtttcgacaggggccagttccataagcagattgctgtcatgcggggccagatcttaaatctgacccaggccttgaaagacaacaagagtcccctgcacctcgtccagatgccacctgtgattgtcgagacggcccgttcccaccagcggtcttctagcgagtcctacacacagagctttcagagccggaagcccttcttttcatggtggtagctccagaggcaggcagaggaaatattgtcagagactggtgggaggaagcctggggagtggggtgcaggaaaagccagagaagccggtggagagcagcacctttaagagccctctctctctgcttgccaccctgctcagagctttccacccacagggagaagcacaatcaggaacagtgagtgctcctcgcccttctgatgtgggggaggctggagctccatgcacgtagtccagatgcctgggaaggaacatctcccttccagcatctgctggtagcaggctgggacagtcccttccttccctgaaaccctgctctattgcaattccctattatattctgcatcagaaaaaaaaaa

SEQ ID NO: 302 - DNA, 3348 bp, Homo sapiens
  CDS (68)..(2914)
cgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggctgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacgtgctgtgctccaactcttcaccacaccctgtattctacaacttctttggcgttttactcctcctagtgctcgaaacttgtgtccggcgatttcagcccccgctctgccttcctcctctcttctcccttacctgatcatcccaccaccttctcccccaggatct

SEQ ID NO: 303 - DNA, 802 bp, Homo sapiens
  CDS (400)..(609)
attggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaatctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgtt

SEQ ID NO: 304 - DNA, 3818 bp, Homo sapiens
  CDS (757)..(2529)
caattttttttttttttttttttttcatgaaaaattctaatttcattcatgttgctacaagtatagcttcatgctttaaaaaaaaatgcgggctggtaacatttttctatcttacttacagtgtagagttaaacaggtgcccttacctctcctccagtgcatggaaaaggactggagtatttagaagtacaaatagcgcccttcttgacaacatcatcttccaggccaaatgtagcggagcagttagtcgcaaagtacttataaggcttccatgttttcccaaagtcctgggagcggtccagcaccatggcagccggcctgggggacttgaacatcacaattaggtgagtgaagtagaattcagcttccaggtctaactggatcttttctctgtgcacatcctccgcagactgccaccatgtgcgaggaaaccggaaggatgagtctgccatggcagatgccaggtgagccaggtgaggataggcagcatcgcacttgtcacatttggactgccgacaagtcagatccgtgttctcactgtagaagcagtacagttcggtagcattctgaccacagtggtggtctgcccagagttttcgccccaaagcgaaatttcccatccgaggggtgcagctttttcacagcgggaactcactccagtactccactcagtcctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccacacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttctcctccctgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatattgctttgttaatttgtttttatatttcatatatgtaataaaggaatatgatctgaaaaaaaaaa

SEQ ID NO: 305 - DNA, 723 bp, Homo sapiens
  CDS (19)..(429)
gatggggcggcgccgagaatggccgttatgaggaccctaagagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagaaaaagttgacaaatttatgattgagctagatgggaccgagaataagtccaagtttggggccaatgccatccaagggccgattccgagcagctgtgcccagtggggcttccacgggtatctatgaggctctggaactaagagacggagacaaaggccgctacctggggaaaggagtcctgaaggctgtggagaacatcaacagtactctgggccctgctctgctgcaaaagaaactaagcgttgcggatcaagactggcgcccctgccgctcggagcgtctggccaaatacaaccaactcatgaggatcgaggaggctcttggggacaaggcaatctttgctggacgcaagttccgtaacccgaagccaagtgagagctggagctccagactcactggacaaccaggtctcagcct

SEQ ID NO: 306 - DNA, 390 bp, Homo sapiens
  CDS (80)..(364)
tgtcctggaattcttctttctgagttcccatttcacagatgggtaaaactgaggtttactcctcgtctagcttcactgaatggcagagcccatagcttgtctttgcctaatctgctgcataatcatttcagcaacaactcaaatgccttttgagggttcttgcttctgtttggtgccttgtaattttcaaccatattttagacactttaggcctaatgatctaaggcatatggtttttacccatggtctgtgggcccttgagaagctgagtcctctgaaagaaaatcagaatgttgcatgcatctgtattttttgtcttagatttcacttgattctcaaatggatccttgactcccccaaagtttaatttattcaacaaatctttttttt

SEQ ID NO: 307 - DNA, 1495 bp, Homo sapiens
  CDS (580)..(1137)
ttttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctaaaaaaaaaaa

SEQ ID NO: 308 - DNA, 961 bp, Homo sapiens
  CDS (65)..(553)
cacccacggttggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcagtgtcttgtgttccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctgggagatggataccgacttgtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaaaaaaaaagtaagtaaagatcaggaacactgggaagtagttttctctggaagcacgacccgggggggggggagaacccaccgcgctaaggggcggaagggggcacacaagggggtgtcgcccctttccacaggtcggtgtcgtgcgaaccaccggttgtgtcaaaaaattggagacggcgcccggcccggagcatctgttcgtccagggggggagcagctggctggcaaaaggcgtaaacccgaggcgaggggaaagcggacagggggtccgcaggtgcacgacacgacacacactccggcggacccacccg

SEQ ID NO: 309 - DNA, 940 bp, Homo sapiens
  CDS (68)..(559)
tttcgtgtttgggggggttggcgacggcagcccgagggcggcgcaaggcctgaggcccagcacagtgatgtccgagctcagcgatgaagccagcgagccggaactcctgaaccgcagcttgtccatgtggcacgggctcgggacacaggtcagcggggaggagctggatgtccccctggatcttcacacagctgcttccattggccagtatgaagtggtgaaggagtgtgtgcagcggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcaaggtgcagagctagaaatgaaagacatccagggctggacagccctcttccactgtaccagcgccgggcaccagcacatggtcaggttcctcttggacagtggagccaatgccaacgtgaggtgattgccacatctttagtggccacaggagtggcctaggtgtcatctgactctaaggagggtggctctggaggcagctaaccagagtttagggccaccctgcttcggcacgagaggctcaagatgaggggtaggaccagagtccttccaggcacaggccttttcgtacatctgtgagatgcatctcttcaagccctctcagcttccttttctttatctgaaacccacctgggtcatacagttgtaagaattacatgttttattgtatgccagggacctaacatactgaatggcatttaaatgtcatacattacatgcaaattccttccattttcttgctttttgtatggatgaggtgaggtgatgctttgaaacagtcatg

SEQ ID NO: 310 - DNA, 1189 bp, Homo sapiens
  CDS (365)..(1186)
gccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcaagaaggccgccctcgctccacgcaacacctgctgctgccaccgcgccgcgatgagcccgcgtggtctcgctgctgctgggcgccgcgctgctctgcgggccacggagccttctgccgccgcgtggtcagcggccaaaaggtgtgttttgctgacttcaaggcatccctgctacaaaatggcctacttccatgaactgtccagccgagtgagctttcaggaggcacgcctggcttgtgagagtgagggaggagtcctcctcagccttgagaatgaagcagaacagaagttaatagagagcatgttgcaaaacctgacaaaacccgggacagggatttctgatggtgatttctggatagggctttggaggaatggagatgggcaaacatctggtgcctgcccagatctctaccagtggtctgatggaagcaattcccagtaccgaaactggtacacagatgaaccttcctgcggaagtgaaaagtgtgttgtgatgtatcaccaaccaactgccaatcctggccttgggggtccctacctttaccagtggaatgatgacaggtgtaacatgaagcacaattatatttgcaagtatgaaccagagattaatccaacagcccctgtagaaaagccttatcttacaaatcaaccaggagacacccatcagaatgtggttgttactgaagcaggtataattcccaatctaatttatgttgttataccaacaatacccctgctcttactgatactggttgcttttggaacctgttgtttccagatgctgcataaaagtaaaggaagaacaaaaactagtccaaaccagtctacactgtggatttcaaagagtaccagaaaagaaagtggcatggaagtataa

SEQ ID NO: 311 - DNA, 1331 bp, Homo sapiens
  CDS (107)..(1114)
aaggatccttaattaaattaatccccccccccgctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgacaccagaagactgtggatgggccctccggggaaactgtggcgtgatggccgcggcggcctctcccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccaccttcgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaa

SEQ ID NO: 312 - DNA, 1029 bp, Homo sapiens
  CDS (139)..(804)
tacgaggccgggtggcggggagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctcaaaaaaaaaaaa

SEQ ID NO: 313 - DNA, 930 bp, Homo sapiens
  CDS (139)..(705)
tacgaggccgggtggcggggagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctcaaaaaaaaaaaa

SEQ ID NO: 314 - DNA, 1572 bp, Homo sapiens
  CDS (333)..(1301)
tgtgcaggactcatcggttacgggacacgagcgcaggaccagcgggcatggggcgtaccgggggtcttttgtttatggcccacccctggaaagccgaggggagggggacgagtccctgaggatctgtgggtgtgagccagccgcgtggccctgggcaacggcgctgccggacagaagtggcggttgctgacgcctggaaattcccctgaaggtggagcaccacccaacccccctgggtcccaccctccctcaaggcctcctccacctccacctccaccccgcctggcctggcgtccacctctgcggctcctacctgggtgcaatcgagttaaatggctgataagcagatcagcctgccagccaagctcatcaatggcggcatcgccgggctgatcggtgtcacctgcgtgtttcccatcgacctggccaagaccaggctgcagaaccagcagaacggccagcgcgtgtacacgagcatgtccgactgcctcatcaagaccgtccgctccgagggctacttcggcatgtaccggggagctgctgtgaacttgaccctcgtcacccccgagaaggccatcaagctggcagccaacgacttcttccgacatcagctctctaaggacgggcagaagctgaccctgcttaaagagatgctggcgggctgtggggctggcacctgccaggtgatcgtgaccacgcccatggagatgctgaagatccagctgcaggatgcagggcgcattgccgcccagaggaagatcctggctgcccagggccagctctcggcccaggggggtgcccagccctcagtggaggctccagctgcccctcggcccacggccacccagctgacccgcgacctgctgcggagccgtggcattgccggtctctacaagggactcggggccacgctgctcagggatgtccccttctctgtggtgtacttcccgctctttgccaacctgaaccagctgggccgcccggcgtccgaggagaagtcgcctttctacgtgtccttcctggccggctgtgtggctgggagtgccgccgctgtggccgtcaacccctgtgatgtggtgaagacgcggctccagtcacttcagcgaggcgtcaacgaggacacctactctgggatcctggactgtgccaggaagatcctgcggcacgagggcccctcggccttcctgaagggcgcctactgccgcgcgctggtcatcgcgccccttttcggcatcgcacaggtggtctacttcctgggcatcgcggagtccctgctggggctgctgcaggacccccaggcctgagcccagcacccgctccaccccagccagctgggcagggccggtgtggggctggagccaggcagctagcccaggacggagcaagggaagacccctccccagccctcccgtcggcaggggcagcagggggcagggtgcagggtccacataggtggtgcacacgcaagccccccggggtgctgcctgcaccgttgggatcaatgtctcatttatgtagaaaatgcagaaatctttacattcctcaagctagcccctgccccaatcctgccct

SEQ ID NO: 315 - DNA, 2024 bp, Homo sapiens
  CDS (19)..(1419)
gtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgccttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactgtctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaacaatagctggttatttctcccttgtgttagtaataaacgtcttgccac

SEQ ID NO: 316 - DNA, 1495 bp, Homo sapiens
  CDS (54)..(710)
ccagcttggcacgagggtcacccacccggactcacattctcccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcggcagaacccccaaagacacacgtgagccagcagcccctctctgaccatgagggcaccctgaggtgctgggccctggggcttctaccctgcggagatcacactgaccttggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggtgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaaaaaaaaaaaa

SEQ ID NO: 317 - DNA, 1559 bp, Homo sapiens
  CDS (43)..(681)
tcgcgatctagacccggactcagagtctcctcagacgccgagatgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgccagatacctggagaacgggaaggacacgcctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctgcgatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgaaagagcaaataaagacctgagaccttccag

SEQ ID NO: 318 - DNA, 2225 bp, Homo sapiens
  CDS (1140)..(1769)
tcaggctttacaagcgatgagagactcatcagagccctgggcactgttgctggacgcagcctgagagcagctccctccttttccacctgagctcttcctcctacacatcacaacagccaccacagctcctaggacagctaggacaaccaggacagccaggccagcaacgatgcccacgatggggatggtgggctgggaagacggcttccatctcagggtgaggggctccggcagcccctcgtgctgcacatggcacgtgtatctctgctcttctccagaaggcaccaccacagctgcccacttctggaaggttccatctcctgctggcctggtctccacaagctcggtgtcctgagtttggtcctccccatcccactgccaggtcagtgtgatctccgcagggtagaagcccagggcccagcacctcagggtggcctcatggtcagagacgggatggtgggtcacgtgtgtctttgggtgttccgcgcgctgcagcgtctccttcccgttctccaggtatctgcggagccactccacgcacgtgccctccaggtaggctctccgctgctccgcctcacgggccgcctcccacttgcgctgggtgatctgagccgccgtgtccgcggcggtccaggagcgcagatcctcgttcagggcgatgtaatccttgccgtcgtaggcgaactggttatacccgcggaggaggcgcccgtccggccccaggtcgcagccaaacatcctctggagggtgtgagacccgtcctcgctctggttgtagtagccgcgcagtttccgcaggttcactcggtcagcctgtgcctggcgcttgtacttctgtgtctcccggtcccaatactccggcccctcctgctccacccacggcgcccggggctcccctctcggactcgcggcgtcgctgtcgaaccgcacgaactgcgtgtcgtccacgtagcccactgagatgaagcggggctctccgcggccgggccgggacacggcggtgtcgaaatacctcatggagtgggagcaggcccaggtctcggtcagggccaggcctcccgagagcagcaggaggagggctcggggcgccatgacccgcccacgcgtccgcggacgcgtgggcggacgcgtgggtggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagccggagagcctacctggagggccgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtgcagcgacagtgcccagggctctgatgtgtctctcacagcttgaaaag

SEQ ID NO: 319 - DNA, 1085 bp, Homo sapiens
  CDS (16)..(657)
ggacgcgtgggcgagatgcgggtcacggcaccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagccctacctggagggcctgtgccgtggagtggctccgcagatacctggagaacgggaaggagacgctgcagcgcgccgggaccccccaaaagacacatgtgacccaccaaacccatctctgaccatgaggccaccctgaggtgcctgggccctgggcttctaccctggggagatcacagctgcacctggcagcgggatggcgaggaccaaatcagggacacgagcttggggaacagaccagcaggcgtcgaactacaaagggacacaggagggggcccctcgagaaggcaaacaccattgcaggacacaggagggctcccaaggccctcacgtaggggaggacgattcaatagagagggccatggacaggggagcacagagatccaaacgggatcgtgcagggcacagacgaagagagaacacgaagagacgaccccgtgggaaaggcagagcactgctactgagcacgccgtcagacacacacacaacacgacgacgacgacgaggacatccctcgccgagcgtga

SEQ ID NO: 320 - DNA, 1100 bp, Homo sapiens
  CDS (1)..(1098)
atggccgtcatggcgccccgaaccctcgtcctgctactctcgggggccctggccctgacccagacctgggcgggctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggccgggcacgtgcgctggagtggctccgcagatacctggagaacgggaaggagacgctgcagcgcacggacgccccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtg

SEQ ID NO: 321 - DNA, 1113 bp, Homo sapiens
  CDS (12)..(875)
tttcgtcgaggatggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagttggctccgcaggatacctgggagaacgggaaggagacgctgcagcgcacggacgcccccaagacgcatatgactcaccacgctgtctctgaccatgaggccaccctgagggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggagccgtcttcccagcccaccatccccatcgtgggcatcattgctggcctggttctctttggagctgtgatcgctggagctgtggtcgctgctgtgatgtggaggaggaagagctcagatagaaaaggagggagctactctcaggctgcaagcagtgacagtgcccagggctctgatatgtctctcacagcttgtaaagtgtga

SEQ ID NO: 322 - DNA, 1221 bp, Homo sapiens
  CDS (1)..(213)
atgcgggtcacggcgccccgaaccctcctcctgctgctctggggggcagtggccctgaccgagacctgggctggtgagtgcggggtcggcagggaaatggcctctgtggggaggagcgaggggaccgcaggcgggggcgcaggacccggggagccgcgccgggaggagggtcgggcgggtctcagcccctccttgccccaggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagaggacctgcggaccctgctccgctactacaaccagagcgaggccgggtctcacaccatccagaggatgtctggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtggaaaaggagggagctactctcaggctgcgtccagcgacagtgcccagggctctgatgtgtctctcacagcttgaaaag

SEQ ID NO: 323 - DNA, 1546 bp, Homo sapiens
  CDS (30)..(686)
ccggactcggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgggaacacccaaagacacacgtgacccaccatcccgtctctgaccatgagggccaccctgaggtgctggggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttc

SEQ ID NO: 324 - DNA, 1491 bp, Homo sapiens
  CDS (60)..(698)
gcgctcttctaaagtccgcacgcacccaccgggactcagattctccccagaccccgaggatggccgtcatggcgccccgaaccctcctcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggacccgcggcggacatggcagctcagatcaccaagcgcaagtgggaggcggcccatgcggcggagcaggcagagagcctacctggagggccggtgcgtggagtggctccgcagatacctggagaacgggaaggagacgctgcagcgcacggacccccccaagacacatatgacccaccaccccatctctgaccatgaggccaccctgaggtgcctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaagatagaaaaggagggagttacactcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccaccccgatgtccaccatgaccctcttcccacgctgacctgtgctccctctccaatcatctttcctgttccagagaggtggggctgaggtgtctccatctctgtctcaacttcatggtgcactgagctgtaacttcttccttccctattaaaattagaacctgagt

SEQ ID NO: 325 - DNA, 1310 bp, Homo sapiens
  CDS (21)..(677)
cggacgcgtgggcgccgaggatggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaaagacacatatgacccaacaccccatctctgaccatgaggccaccctgaggtgctggggccctgggcttctaccctgcgggagatcacactgacctggcagcggggatggggaggaccagacccaggacacggagctcgtggagaccaggccctgcaggggactggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtctctcacagcttgtaaaggatgtgatgcatgtattgaatcaaagacgtctctaaggcactgttttcagaaggaagaatacgcgggtccaaaaaccaagaagtcaaagcagctgtcttcccagcccaccatccccatcatgggcatcgttactgtcctggttgttcttggtgctgttttcaccagagctgtggtcactgctgtgatgtga

SEQ ID NO: 326 - DNA, 2026 bp, Homo sapiens
  CDS (179)..(1882)
tttcgtgcctccagagcctccgggtctgggcggcgcttcggctcctcccgagccgcctgctagccccgcgccgcactccatccccacaggctggggacgggcccggtgcggctgtgtgggttcgggagcggagttgcagaatccaaggacccattttgttctttctccgcactgctttatgggaggcattatggcccccaaagacataatgacaaatactcatgctaaatccatcctcaattcaatgaactccctcaggaagagcaataccctctgtgatgtgacattgagagtagagcagaaagacttccctgcccatcggattgtgctggctgcctgtagtgattacttctgtgccatgttcactagtgagctctcagagaaggggaaaccttatgttgacatccaaggtttgactgcctctaccatggaaattttattggactttgtgtacacagaaacagtacatgtgacagtggagaatgtacaagaactgcttcctgcagcctgtctgcttcagttgaaaggtgtgaaacaagcctgctgtgagttcttagaaagtcagttggacccttctaattgcctgggtattagggattttgctgaaacccacaattgtgttgacctgatgcaagcagctgaggtttttagccagaagcattttcctgaagtggtacagcatgaagagttcattcttctgagtcaaggagaggtggaaaagctaatcaagtgcgacgaaattcaggtggattctgaagagccagtctttgaggctgtcatcaactgggtgaagcatgccaagaaagagcgggaagaatccttgcctaacctgctacagtatgtgcggatgcccctactaacccccaggtatatcacagatgtaatagatgctgagcctttcatccgctgtagtttacaatgcagggatctggttgatgaagcaaagaagtttcatctgaggcctgaacttcggagtcagatgcagggacccaggacaagggctcgcctaggagccaatgaagtgcttttggtggttgggggctttggaagccagcagtctcccattgatgtggtagagaaatatgaccccaagactcaggagtggagctttttgccaagcatcactcgtaagagacgttatgtggcctcagtgtcccttcatgaccggatctacgtcattggtggctatgatggccgttcccgccttagttcagtggaatgtctagactacacagcagatgaggatggggtctggtattctgtggcccctatgaatgtccgacgaggtcttgctggagccaccaccctgggagatatgatctatgtctctggaggctttgatggaagcaggcgtcacaccagtatggagcgctatgatccaaacattgaccagtggagcatgctgggagatatgcagacagcccgggaaggtgccggactcgtagtggccagtggagtgatctactgtctaggaggatatgacggcttgaatatcttaaattcagttgagaaatacgaccctcatacaggacattggactaatgttacaccaatggccaccaagcgttctggtgcaggagtagccctgctgaatgaccatatttatgtggtggggggatttgatggtacagcccacctttcttccgttgaagcatacaacattcgcactgattcctggacaactgtcaccagtatgaccactccacgatgctatgtaggggccacagtgcttcgggggagactctatgcaattgcaggatatgatggtaattccctgctaagtagcattgaatgttatgaccctatcatcgacagctgggaagtcgtgacatccatgggaacccagcgctgtgatgctggtgtttgtgttctccgcgagaagtgaccattgttggagcaccatccagagctagtgaccagtccagtggacagttagtgggagaatcaaaaatcctttccagaatgtctgtttctcactacgtgcaccgggtgattacaggcaccagtgcagtgaaaaaaaaaaaaa

SEQ ID NO: 327 - DNA, 1686 bp, Homo sapiens
  CDS (355)..(1683)
gttctttcatttaccaaagtgacatgcacctactaggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaaattacgaactcactgagctggaagtcattcaacgggaattgaataggtaactgcacttttgtgagattataaatataccacggagggtaacgaagctacagaagaatggaagaagacagcctggaagactcaaaccttcctccaaaagtttggcattctgagatgacggtgtcagtgacaggcgaaccacctagtaccgtagaagaagaaggaatacctaaagaaacagacatagaaatcatcccagaaatcccggaaactctagagccactgtcccttccagatgtgctgaggatctcggcagttctggaggacaccacagaccagctctctattctgaactacatcatgcccgttcagtacgaagggagacagagcatctgcgtgaaaagcagagaaatgaatctagaaggaacgaatctagacaaacttccaatggcctcaacaatcacaaaaatacccagtccgttaataactgaggaaggacccaacttgccagaaatcagacacagaggccggttcgctgtggagtttaacaaaatgcaggatcttgtcttcaaaaaacctacaaggcagaccatcatgactacggagacactgaagaaaattcagattgataggcagtttttcagcgatgtgattgcagataccattaaggagttgcaagattcggccacttacaacagtctcctgcaagctttgagcaaagagagggaaaacaaaatgcatttctatgacatcattgccagggaggaaaaaggaagaaaacagataatatcacttcaaaaacagctaattaatgtcaaaaaggaatggcaatttgaagtccagagtcagaatgagtatattgctaacctcaaggaccaactgcaagagatgaaggcaaaatccaacttggagaatcgctacatgaaaaccaataccgagctgcagattgcccagacccagaaaaagtgtaacagaacagaggaactcttggtggaagattttgagaaactcaggatgaaaaccgaagaagaggcccggactcatacagagattgaaatgttccttagaaaggagcagcagaaacttgaggagaggctggagttctggatggagaaatacgataaggacacagaaatgaaacagaatgaactaaatgctctcaaagccacaaaggccagtgacttagcacaccttcaagacctggcaaagatgataagagagtatgaacaggtcatcattgaagatcgtatagaaaaggagaggagcaagaagaaggtaaaacaggatctcttggaattaaagagcgttataaagctccaggcctggtggcgaggcactatgatacggagagaaattggtggtttcaagatgcctaaagacaaagttgatagcaaggattcaaaaggcaaaggtaaaggcaaggataagaggagaggcaagaagaagtga

SEQ ID NO: 328 - DNA, 2199 bp, Homo sapiens
  CDS (95)..(1768)
ccggccgcccgggtcgacgatttcgtagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctgggggcagatatacctaccacaggagcccctgtctttcataggggcaaggatccacatacccatagagttcagggttttagaaggtttgggatttttttgaatttgttctaaaatatcgcaggtgtgtggaaaatgcttttttcggggggaaaagtcagggttttttaagggggctgttc

SEQ ID NO: 329 - DNA, 784 bp, Homo sapiens
  CDS (501)..(728)
gtacccctgtatccggggaggggtattcattgttggtgaaatatgtcgaggaccagatgctttttggtctcccaaagacctatcaaactgcagatcttttggctttgtaatatattcagttccacatttattcattcaagatttttgtgtcctcattatgtgccaagtactgggttggacactaggtgacagagatgaacaaatccctaatcttgggatttcacagtggatgttggaatttagtaccgtttagcttcattaggttctgcagtagtcccaagattttccaagatcatcctgtcctccagtgttctattgattcaacttcagaatatatcccagactctgtccctctttactcctcactgctgttgccctgggtccatctgccatcatctctcacctggattatctcagtagtttcccaactggtttccttgtttccattcttgcctccttctgtctactctcaatataacagctagaacaatccttttacaatggaattcagatcatgtttacccctctgttcaaattctccagtgactttccagtttttacatgatctggctcctactacctgtctcactgtgtttcctactactctcctgctctttctcctcttaataaacactgggctcatggtgtttcctttaacatgccaggcatgcttgaccctgtcctgtctcagggccctgctgttccctctgcctggaacattcttcccatagtgtctgcatggctcgctctctcactgctttggattgctgctcagaagtcacct

SEQ ID NO: 330 - DNA, 542 bp, Homo sapiens
  CDS (61)..(216)
gctcttttcgctgatttttaaatttactttgctactttgatgattaattggcaatgatcaatgcacaaccttttactctcatgtgttattttcaattttccccttgtgtttattgtagcaagaactccctaccttccttccttattatctatttgtaatttggaagccccagtataccttagaattgatccaggatggcctcatttatgtatggcttgagagttttttaacagaaaaaacattgattctctaaaaaataagagtttttatcatagtttctcaatattttcctatctacaaggacaaaattttttttcagaagcaaaacaactagcatactaactttctgtttatgcatgtagtaaatattggatgattactgcacaatttccaggaattatgcagagataactacagagatgagtagaataaaactcattttagagcttcaaactctagtcagagatgtagttacaaacaaataatccagtgtagttagttaggtactctggcagaagtgtaatgaaagtagtatgaaaaaa

SEQ ID NO: 331 - DNA, 357 bp, Homo sapiens
  CDS (151)..(264)
gggctcggcgtgggccttggtctgtaaaggggcgtctacgcggcagcagccgtgatcatgggggccctgggctaggcaacagcactagttgtcgcgcgtcaccaaacactgtgaagcacctctctagcggagacctgctccaggatcaacatgctgtggggcacagaaattaatgggttagctaacgctttcattgaccaaaggaaactcatccgagatgatgtcatgactcagctggccctatatgagctgaaaaatctcacttagtatagctagctgttgggtggttttccatggacacttccacaggcagaagccctagactaagcttcttagacagacaaagtgattagcccg

SEQ ID NO: 332 - DNA, 1046 bp, Homo sapiens
  CDS (4)..(888)
gttatgctgctgaaggaatcttgtggaaatgtttttttctctgcagtgagaataaggaggagcaggaaacacagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaaagcatgcaaagtcattgttacaacagggatctacagaactatttcaccaccagatatgacctagttttatatttctgggaggaaatgaattcatatctagaagtctggagtgagcaaacaagagcaaaaaaaaaa

SEQ ID NO: 333 - DNA, 1280 bp, Homo sapiens
  CDS (189)..(1196)
  misc_feature (1)...(1280): n = a,t,c or g
acgtggcggcggagccctgggtcggtgtctgcgcgctggtgtctgaggcccaggctgaggcctccgctattgctggagcgcaggcggcggagaggatgactgccgctgccattctctcttgagctagcgagccgccgccaccctccaccctcccccggcagggcggagaggagcggccggagtcagcgatggtgcccggcgaggagaaccaactggtcccgaaagaggcaccactggatcataccagtgacaagtcacttctcgacgctaattttgagccaggaaagaagaactttctgcatttgacagataaagatggtgaacaacctcaaatactgctggaggattccagtgctggggaagacagtgttcatgacaggtttataggtccgcttccaagagaaggttctgtgggttctaccagtgattatgtcagccaaagctactcctactcatctattttgaataaatcagaaactggatatgtgggactagtaaaccaagcaatgacttgctatttgaatagccttttgcaaacactttttatgactcctgaatttaggaatgcattatataagtgggaatttgaagaatctgaagaagatccagtgacaagtattccataccaacttcaaaggctttttgttttgttacaaaccagcaaaaagagagcaattgaaaccacagatgttacaaggagctttggatgggatagtagtgaggcttggcagcagcatgatgtacaagaactatgcagagtcatgtttgatgctttggaacagaaatggaagcaaacagaacaggctgatcttataaatgagctatatcaaggcaagctgaaggactacgtgagaagtctggaatgtggttatgagggctggcgaatcgacacatatcttgatattccattggtcatccgaccttatgggtccagccaagcatttgctagtgtggaagaagcatggcgtgcatttattcagccagagattctggatggcccgattcagtatttttgtgaccgttgtaagaagaagtgtgatgcacggaagggccttcggtgtgcgcattttccttatctgctgaccttacagctgaaaagattcgattttgagtatgcaaccatgcataggattaaactgaatgatcgtatgacgtgtcccgaggaactatatatgaaagcccccccgatgggaagatgagagctctcaacaatataaagctgcttgacagtatagcatgtatgcgccgcgtctagttncctaacctacgtgcgcgtccgc

SEQ ID NO: 334 - DNA, 814 bp, Homo sapiens
  CDS (403)..(669)
tttcttagggataagctgggaaatttttacaggtgtggaggatatttcaaatacatcttttgcctttgcactaacatgctttcatttctttcagactcttcctccattccctttaaagtcttccccatcatatcactgatctcaaaagctagatttgtcttcattatagtcgtatccctaaaaccatgcattggtctggacaggagttgtcccatattcccttgcagactggtcactccatgttctctgttacagaaaggaccagccaagcttcagctgtcccattcctccccctacaacacacacacctttcaggcagggaggagatgagcttccagccccaagagtggaggctgccacatcctaacatagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctcctgggactgggctgaggcaggggcttcgctctattctccctaaccatactgtcttcctttcccccttgccacttagcagttatccccccagctatgccttctccctccctcccttgccctggcatatattgtgccttatttatgctgcaaatataacattaaactatcaagtgaaaaaaaaaaaa

SEQ ID NO: 335 - DNA, 500 bp, Homo sapiens
  CDS (90)..(401)
gcccacgcgtccgggggaggcggggtaagtttggtgggaaactctgtaatttccttttttactttcacagcaatagtgcagaatccagaatggatgtcctctttgtagccatctttgctgtgccacttatcctggatgactttagtgcagatttcaccattgattactccatatttgagtcagaggacaggctgaacaggttggataaggacataacagaagcaatagagactaccattagtcttgaaacagcacgtgcagaccatccgaagcctgtaactgtgaaaccagtaacaacggaacctcagagtccagatctgaacgatgccgtgtccagtttgcgaagtcctattcccctcctcctgtcgtgtgcctttgttcaggtggggatgtatttcatgtagaaggtggaagaaggctgctatgactctttggatgggagtctggcaagaggaaattggaagataaaataaataataagtgaaataaaaaaaaaaaaa

SEQ ID NO: 336 - DNA, 800 bp, Homo sapiens
  CDS (258)..(416)
attagacttaccctctatctaattccaagattccattactttctcccctttgcttaaaagcatttttaaatgtacaatgccgtatatggctatcatagaccaaaatatgacgtatacctgtgtggagagacacaacgactatcatacctttgtggtgtgggccaacgatgaggaccacctgctgctcatatcgctgcagaatgggggcatcctgacggagatcggagcactctctctagattcatgactatgagtgcatgcgcaaccatcaacagggctacatcctcacctgcccatccaacctgggcaccgggctgcgggcaggtgtgcatatcaagctgcccaacctgggcaagcatacagctcccacacccctttcagcgcgctatcgcttgtttaactggcgactacggtattgagctctgcccttgtcctgcctctggtgagggtgagccagtcaagaaggtgagggttagtaccgccctaccagatctggaggattactccccgtgtgcactacctccagagtatgtaccacagatttttcccatgggggtgtcttccagtcaaggggacatcccataagtagttttgagagggtggatgggttccttgcccaccagaaccagccctagtcccggctccttgcgttcctgtggcccctccgttcccccttagaataggcctgaaagggctggaaagggccagtattgggggtgtgagctagctttacccccgcaggacatacacaggagcctttgatctcattaaagatatgtgccccagctaaaaaaaaaaaa

SEQ ID NO: 337 - DNA, 1475 bp, Homo sapiens
  CDS (532)..(1386)
cctctcttaacagactccagaaattgagcatttgttggttcattgtaaggtctcaattctccatcatctaaactgaaaccattgctccacagtttaagcaaaatctgaaccacttttggacctggccggaccacggagtgcccattgaccccaggggtgtgctggacttcctggaggaggtgcaccataagcaggaacgcatcatgcatgcaaggccagtcgtggtgcacggcagtgctggaattggccggacagggacatacgttgtgattgatattctgactgacatcaacagagagaaaggtgttgactgcaacattgacgttctcaaaacgttgaggtggtgtccgtgggctcttgaagactgtggctttaggtctattagacttggaagatttgcacttcacttcatcttcatacaattctgccaaggccaacttgcgcgtcttcgcccctcctgcggttgccaggcaaccggccccggaagttgcggcaggtgcgtccgcagcgggcgccgctagccagcggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaa

SEQ ID NO: 338 - DNA, 1613 bp, Homo sapiens
  CDS (532)..(1524)
cctctcttaacagactccagaaattgagcatttgttggttcattgtaaggtctcaattctccatcatctaaactgaaaccattgctccacagtttaagcaaaatctgaaccacttttggacctggccggaccacggagtgcccattgaccccaggggtgtgctggacttcctggaggaggtgcaccataagcaggaacgcatcatgcatgcaaggccagtcgtggtgcacggcagtgctggaattggccggacagggacatacgttgtgattgatattctgactgacatcaacagagagaaaggtgttgactgcaacattgacgttctcaaaacgttgaggtggtgtccgtgggctcttgaagactgtggctttaggtctattagacttggaagatttgcacttcacttcatcttcatacaattctgccaaggccaacttgcgcgtcttcgcccctcctgcggttgccaggcaaccggccccggaagttgcggcaggtgcgtccgcagcgggcgccgctagccagcggaagatggcggagggcggaggccctgagcccggcgagcaggagaggaggtcttccgggccgcggcctccgagcgcgcgggatttgcagttggccttggcagaattgtatgaagatgaagtgaagtgcaaatcttccaagtctaatagacctaaagccacagtcttcaagagcccacggacaccacctcaacggttttactcaagtgaacatgaatacagtggattaaatatagttcgaccttcaactgggaaaattgtgaatgaacttttcaaagaggcaagggaacatggggctgtccctctgaatgaagccacaagagcttcaggtgatgataaatctaagtcatttacaggtggaggatacagattgggtagttctttttgtaagcggtctgaatatatctatggagaaaatcagctgcaagatgttcagattttgcttaaactgtggagcaatggtttcagtttagatgatggagaattgagaccttacaatgaaccaacaaatgctcaatttctggagtctgttaagagaggagagattcccctggagcttcagcgccttgttcatggtggccaagtgaatttggatatggaggatcatcaggatcaagaatacataaaacctagattgaggttcaaggcttttagtggagaagggcaaaaacttggaagccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaa

SEQ ID NO: 339 - DNA, 1924 bp, Homo sapiens
  CDS (120)..(503)
tttcgtgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagcaagatctgtataatggcaagacaaccaaactagcaacttagcaagaatgtgctctgtagtgcatgcagtggccaaggcggaaagtctggagctgtccaaaagtgtagtgcttgtcgaggtcgaggtgtggcgcatcatgatcagcacagctgggctccagggcatggtacaacagatgcagtctgtgtgctctgattgtaatggacgaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggcccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatcccagatgaactgagggacatctgttggtctatgtataacttttaaaattggtatagtatctacagagtgtataatttaaactaaccacaaagctttacatcttcattttgactgttccatagcaaaataaagcacttgaaaggaaacaaaactccctttcacacatggattattataagtttcaatcctggtatctgtgcttgatttttatcagttttgtgtaaatttttatgtttcatattttaaatttaaatcccacattgtaaagtttgtacaatttgtcctgaagctttgtgtttggctgcacctgcataagctgctacaaataaaataaaaaatttcatagcctgtatctatcatttaaatgcatggaaaaaaatgggctttgcacacaatgggtttggagctgactgggaacaatggaaaaaattacattagctgtggttgtaaagtttttttgtttttgggttttg

SEQ ID NO: 340 - DNA, 2304 bp, Homo sapiens
  CDS (61)..(1974)
aaggatccttaattaaataatcccccccccccgggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaaaaaaaaaa

SEQ ID NO: 341 - DNA, 13941 bp, Homo sapiens
  CDS (1547)..(13120)
gcactgcagcgccagcgtccgagcgggcggccgagctcccggagcggcctggccccgagccccgagcgggcgtcgctcagcagcaggtcgcggccgcgcagccccatccagccccgcgcccgccatgccgtccgcgggccccgcctgagctgcggtctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagccttgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcttgccacccccaggcctgcgccaatggctgcacgtcagggccagggctacccggggccccctatgcgctatggagagagttcctcttctccgttgccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggatgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggaactttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtgaccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcagatgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgagcaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggag

SEQ ID NO: 342 - DNA, 1795 bp, Homo sapiens
  CDS (26)..(1222)
  misc_feature (1)...(1795): n = a,t,c or g
tggggtcactcgagaccctgagggtatggaggaatcacaagacatagaagagctgggacctctgaattactatgtggaggaaatcacatatctatcacaaacaactactttggactctctatacgctggattcgtagaagtacctgaggaatcacctaagcaaccctctgaagtcaatgttaacccactctatgtctctcctgcatgtaaaaaaccactaatccacatgtatgaaaaggagttcacttctgagatctgctgtggttctttgtggggagtcaatttgctgttgggaacccgatctaatctatatctgatggacagaagtggaaaggctgacattactaaacttataaggcgaagaccattccgccagattcaagtcttagagccactcaatttgctgattaccatctcaggtcataagaacagacttcgggtgtatcatctgacctggttgaggaacaagattttgaataatgatccagaaagtaaaagaaggcaagaagaaatgctgaagacagaggaagcctgcaaagctattgataagttaacaggctgtgaacacttcagtgtcctccaacatgaagaaacaacatatattgcaattgctttgaaatcatcaattcacctttatgcatgggcaccaaagtcctttgatgaaagcactgctattaaagtatttccaacacttgatcataagccagtgacagttgacctggctattggttctgaaaaaagactaaagattttcttcagctcagcagatggatatcacctcatcgatgcagaatctgaggttatgtctgatgtgaccctgccaaagaatcccctggaaatcattataccacagaatatcatcattttacctgattgcttgggaattggcatgatgctcaccttcaatgctgaagccctctctgtggaagcaaatgaacaactcttcaagaagatccttgaaatgtggaaagacataccatcttctatagcttttgaatgtacacagcgaaccacaggatggggccaaaaggccattgaagtgcgctctttgcaatccagggttctggaaagtgagctgaagcgcaggtcaattaagaagctgagattcctgtgcacccggggtgacaagctgttctttacctctaccctgcgcaatcaccacagccgggtttacttcatgacacttggaaaacttgaagagctccaaagcaattatgatgtctaaaagtttccagtgatttattaccacattataaacatcatgtataggcagtctgcatcttcagatttcagagattaaatgagtattcagttttatttttagtaaagattaaatccaaaactttacttttaatgtagcacagaatagttttaatgagaaatgcagctttatgtataaaattaactatagcaagctctaggtactccaatggtgtacaatgtcttttgcacaaactttgtaacttttgttactgtgaatccaaacattactctttggacagtttggacagtatctgtattcagattttacaacatggagtaaagaaacctgttatgaattagattacaagcagccttcaaaagaattggcactgggataagatttttcagaaaaagnaaaacatcggcaaactgtgtgtgatttttccaaagctatataaagaaccaaaggtttagtcaagnaacaaaaatcttaaagnttattataacccagactaaggttgaacaacctgcatgnccagagaaaactatggcgacaaaggggaaaaggncaccacttcgtttttcttcactg

SEQ ID NO: 343 - DNA, 2071 bp, Homo sapiens
  CDS (224)..(1183)
ctggcccggaaccccgggacgacccacgcgtccgcccacgcgtccgcctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagaagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacataaaaggaagcaatgccacggctccagggtttcagatgagatcccatctcaaacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccatgtatt

SEQ ID NO: 344 - DNA, 2437 bp, Homo sapiens
  CDS (1160)..(2206)
ggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggccgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaatgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcgcgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgc

SEQ ID NO: 345 - DNA, 2109 bp, Homo sapiens
  CDS (1)..(2106)
atgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatcgcatccggcacctctatgagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgtcaaggaggctcaagagaccatcgataacccacgaaacgtcttgtgcgttttagaaaaatacgccccctggcggacgcagtttagcaaacggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactag

SEQ ID NO: 346 - DNA, 2335 bp, Homo sapiens
  CDS (20)..(1315)
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggcccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagccgctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggactagggctcccgtcctgctttgcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaaccttt

SEQ ID NO: 347 - DNA, 579 bp, Homo sapiens
  CDS (20)..(448)
tttcgtttgggcctggcccatggcggaaatgagagcttgtcgcccattggtccgaccttccctgcaatgcgtcaaactggggcgagccactgcaaggtggtggtgggtggtcaaggtgaagccccacgacaaggatgccaaaatgaaataccaggagtgcaacaagatcgtgaagcagaaggcctttgagcgggccatcgcaggcgacgagcacaagcgctccgtggtggactcgctggacatcgagagcatgaccatcgagggtgagtacagcggacccaagcttgaggacgacaaagtgacaatcaccttcatgaaggggctcatgcagtggtacaaggaccagaagaaactgcaccagaaatgcgcctaccaggtaatgcacctgtcaggtaccgggcacccaggaaccctgggatggcatcacagcactgccaggcgcgggcactgagcaaaatgacaggagaagggcagccacaacagccaacaccaaacaggagtcgtggtcattatggattggcagtaatccctcccaatattcagatacaataaactatctctacaaataaaaaaaaaaaa

SEQ ID NO: 348 - DNA, 582 bp, Homo sapiens
  CDS (79)..(249)
ccgacgatttcgtcggagtgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccccccaacccggccaggctggagcgaccgtgtctggggagccgagccccgcttctcgctgcggtgagcccggactaggggcacgcactgcgcagactccccgactgcagtgggcaggagctcccacaggccccgccccctcactcacgcaaaccgtcgaacagccggacaccagacagaaagcagggcgacaccaagaggagagatagcagacagacgacctgagcaacgagagccggaagagccacccatcaacaggacgtaaacaacaccacgcaacaacaagctagcccaacataaagaaacgtgccaaggacagagaagaaccatgcacaccacccaacatacacaaccatcgagctcatgccgaataacccccaaaccattgaccggaaca

SEQ ID NO: 349 - DNA, 3518 bp, Homo sapiens
  CDS (195)..(2417)
acacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatgacctcagccgacgtgatgtggcaggatggctccgtggaatgcaacatccgctccaacgacctcttccctgtgcaccacctggacaacaacgagttctgccctggagacttcgtggtagataagcgagtccagagctgtccagaccctgctgtctacggtgtggtacagtctggggaccacatcggccgtacctgcatggtgaagtggttcaagctgaggccgagtggggacgacgtggagctgattggagaagaggaagatgtgagtgtttacgacattgctgaccaccctgactttaggttccgtacaactgacatcgtcatccgcatcggcaatactgaggatggggctcctcacaaggaggatgagccatcggtgggccaggtggcccgtgtggacgtcagcagcaaggtggaggtggtgtgggctgacaactcaaagaccatcatcctgccccagcacttgtacaacatagagtctgagattgaggagtcagactacgattcggtagaaggcagcaccagcggggcatcctcggatgaatgggaagatgatagtgacagctgggagacggacaatgggctggtggaggacgagcaccccaagatagaggagccccccatcccacccctggagcagccggtggcccctgaggacaagggagtggtgatcagtgaagaggcagccacagctgccgtccagggggctgtggccatggctgcccccatggccgggctgatggagaaggctggcaaggacgggccacccaagagcttccgggagttgaaagaggccatcaagatcctggagagcctcaagaacatgactgtggagcagctgctgacgggctcgcccacctctccgactgtggagcctgagaagccaactcgggagaagaagtttctggatgacatcaagaagctacaggaaaacctcaagaagaccctggacaatgtggccattgtagaggaggagaagatggaagcagtgcccgacgtagagcgcaaggaggacaagcccgaggggcagtcacctgtgaaggctgagtggcccagcgaaaccccggtgctgtgccagcagtgtggcggcaagcctggcgtcaccttcaccagcgccaagggcgaggtcttctccgtactggagtttgcaccctcaaatcattcttttaagaaaattgagttccagcctccagaagccaagaagttcttcagcacagtgcggaaggagatggcgctgctggctacctcactgcctgagggcatcatggtcaagacttttgaagatagaatggacctcttctcagctctcatcaagggccccactcgaaccccctacgaggatggcctctacttgtttgacatccagctccccaacatctacccagccgtgcccccccacttctgctacctctcccaatgcagtggccgcctgaaccccaacctgtatgacaatgggaaggtgtgtgtcagcctcctgggcacctggattggaaaggggacagagaggtggacaagcaagtccagccttctccaggtgctcatctccatccaaggtctgatcctggtaaatgaaccatactacaacgaagccggcttcgacagtgaccgaggcctgcaggaaggctatgaaaacagtcgctgttacaatgagatggcgctgatccgcgtggtgcagtccatgacccagctggtgcggcggccccccgaggtctttgagcaggagatcaggcaacactttagcactggtggctggcggctggtgaaccgtatcgagtcctggctggaaacccatgccctgctggagaaggcccaggcactgcccaacggggtgcccaaggccagcagctcgccagagcccccagctgtagccgagctgtcagactccggccaacaagaacctgaggatggagggccagccccaggagaggcctcccagggctcagactcagagggcggtgcccagagcctggcctcagctagcagggaccacacagaccagacttcggagaccgcaccagacgcatcggtgccacccagtgtgaaaccaaagaagcggagaaagagctaccggagcttcttacctgagaagagtggctaccctgacatcggcttccccctcttcccactttccaagggtttcatcaagagcatccggggtgtcctgacgcagttccgggctgccctgctagaggcaggcatgccggagtgcacagaggacaagtagctgccaggcacagaggaaagagcatcaccgtgggagaggccagccgccgcctgctcactcccccccggaatcacccctcttcccatgcccctctgtccccactgcaaacccactgccctcttctccccaaggtgagtttgatgctgaagtgcaagaagtgtgttgagatgctgccgtttctattttgaagcgagctttcaacaggcgggtcccctgtggcaaagaaaatcggaaccctgttgccgattttccatttgtcaccccagcagaatgtccggcacttgctcccttgctgccccttctcaggtcagaggcgggtgttccagggcctgccgcggggctctctgggccggttccctgcagacccgcaggagagcacatgtgccttgcatgaagtgtgggttgcgccaacaattcccctggtccctttcaacctgtttagttcaactcaagcctccctgtgtcccagaccctcctgctgccaccaccacccaggtcctccctagtcctccagcgtcaacactatcccttgggagttgtagctgctgtcactgactcccggctatacatggcctgtcgaccacgttatagccctcaggcctgttgaacttgctctctaagagaggttgggaccaggctaggttccgggtgacgcccaggagaggtggtggccttcacacatgcacatggagttgaggaccagggagctgcagggaaagcaacagctataggtgccttgctcttctgtcggaggctgctgggggcaagagcagctgcacaaggccagggcaagtgctagggcccctcccccatcacatggtcacactgggacaggcgtgcagctcactgaactccaagcgagccagccctctcttggactagaaggcctactgtcagcccttcgcttacaaactgcaggctcaatccgaaggggacggccggcgggggctctcctagtgcccagagacaggcccagaggtttacaagttttttaagcttttgataatgtgaagctccaggccgagaggatgctgttgagcacattgcagctatgtaatttttggtgtatgtatgtaatatttaaggttggaaaaaaaa

SEQ ID NO: 350 - DNA, 6599 bp, Homo sapiens
  CDS (78)..(6596)
acggccctcagatgctggcatatatacatgtgttgctactaacatagcaggcactgatgaaacagagataacgctacatgtccaagaaccacccacagatggaagatctagaacctccatataacactactttccaagaaagagtggccaatcaacgcattgaattttcatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaagatactgaagctcttcagagccactccagaggatgcaggaagatattcctgcaaagcaattaatattgcaggcacttctcagaagtactttaacattgatgtgctaggtaccaacttcccaaatgaagtctcagttgtcctcaaccgtgacgtcgcccttgaatgccaggtcaaaggcactccctttcctgatattcattggttcaaagatggcaatattaaaggaggaaatgtcaccacagacatatcagtattgatcaacagccttattaaactggaatgtgaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaaagctgctggaaacccttctcccattctcacctggttgaaagatggtgtacctgtgaaagctaatgacaatatccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttaattgatgaaagggatggattcaagattttattaaatggacgcaaactggttattgctcaggctcaagtgtcaaacacgggcctttatcggtgcatggcagcaaatactgctggagaccacaagaaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatcgtctactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtgcacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccaggcctcagtatatctgaaaatagaagtgtgttaaagattgaagatgctcaggttcaagacactggtcgttacacttgtgaagcaacaaatgttgctggaaaaactgaaaaaaactacaatgtcaacatttgggtccccccaaatattggtggttctgatgaacttactcaacttacagtcattgaagggaatctcattagtctgttgtgtgaatcaagtggtattccacccccaaatctcatctggaagaagaaaggctctccagtgctgactgattccatggggcgagttagaattttatctgggggcaggcaattacaaatttcaattgctgaaaagtctgatgcagcactctattcatgtgtggcgtcgaatgttgctgggactgcaaagaaagaatacaatctgcaagtttacattagaccaaccataaccaacagtggcagccaccctactgaaattattgtgacccgagggaagagtatctccttggagtgtgaggtgcagggtattccaccaccaacagtgacctggatgaaagatggccaccccttgatcaaggcaaagggagtagaaatactggatgaaggtcacatccttcagctgaagaacattcatgtatctgacacaggccgttatgtgtgtgttgctgtgaatgtagcaggaatgactgacaaaaaatatgacttaagtgtccatggaggcaggatgctacggctgatgcagaccacaatggaagatgctggccaatatacttgcgttgtaaggaatgcagctggtgaagaaagaaaaatctttgggctttcagtattagtaccacctcatattgtgggtgaaaatacattggaagatgtgaaggtaaaagagaaacagagtgttacgctgacttgtgaagtgacagggaatccagtgccagaaattacatggcacaaagatgggcagcccctccaagaagatgaagcccatcacattatatctggtggccgttttcttcaaattaccaatgtccaggtgccacacactggaagatatacatgtttggcttccagtccagctggccacaagagcaggagcttcagtcttaatgtatttgtatctcctacaattgctggtgtaggtagtgatggcaaccctgaagatgtcactgtcatccttaacagccctacatctttggtctgtgaagcttattcatatcctccagctaccatcacctggtttaaggatggcactcctttagaatctaaccgaaatattcgtattcttccaggaggcagaactctgcagatcctcaatgcacaggaggacaatgctggaagatactcttgtgtagccacgaatgaggctggagaaatgataaagcactatgaagtgaaggtgtacacacttaatgctaacattgttataattgaatcacagccccttaaatccgatgatcatgttaatattgctgcgaatggacacacacttcaaataaaggaggctcaaatatcagacaccggacgatatacttgtgtagcatctaacattgcaggtgaagatgagttggattttgatgtgaatattcaagttcctccaagttttcagaaactctgggaaataggaaacatgctagatactggcaggaatggtgaagccaaagatgtgatcatcaacaatcccatttctctttactgtgagacaaatgctgctccccctcctacactgacatggtacaaagatggccaccctctgacctcaagtgataaagtattgattttgccaggagggcgagtgttgcagattcctcgggctaaagtagaagatgctgggagatacacatgtgtggctgtgaatgaggctggagaagattcccttcaatatgatgtccgtgtactcgtgccgccaattatcaagggagcaaatagtgatctccctgaagaggtcaccgtgctggtgaacaagagtgcactgatagagtgtttatccagtggcagcccagcaccaaggaattcctggcagaaagatggacagcccttgctagaagatgaccatcataaatttctatctaatggacgaattctgcagattctgaatactcaaataacagatatcggcaggtatgtgtgtgttgctgagaacacagctgggagtgccaaaaaatattttaacctcaatgttcatgttcctccaagtgtcattggtcctaaatctgaaaatcttaccgtcgtggtgaacaatttcatctctttgacctgtgaggtctctggttttccacctcctgacctcagctggctcaagaatgaacagcccatcaaactgaacacaaatactctcattgtgcctggtggtcgaactctacagattattcgggccaaggtatcagatggtggtgaatacacttgtatagctatcaatcaagctggcgaaagcaagaaaaagttttccctgactgtttatgtgcccccaagcattaaagaccatgacagtgaatctctttctgtagttaatgtaagagagggaacttctgtgtctttggagtgtgagtcgaacgctgtgccacctccagtcatcacttggtataagaatgggcggatgataacagagtctactcatgtggagattttagctgatggacaaatgctacacattaagaaagctgaggtatctgacacaggccagtatgtatgtagagctataaatgtagcaggacgggatgataaaaatttccacctcaatgtatatgtgccacccagtattgaaggacctgaaagagaagtgattgtggagacgatcagcaatcctgtgacattaacatgtgatgccactgggatcccacctcccacgatagcatggttaaagaaccacaagcgcatagaaaattctgactcactggaagttcgtattttgtctggaggtagcaaactccagattgcccggtctcagcattcagatagtggaaactatacatgtattgcttcaaatatggagggaaaagcccagaaatattactttctttcaattcaagttcctccaagtgttgctggtgctgaaattccaagtgatgtcagtgtccttctaggagaaaatgttgagctggtctgcaatgcaaatggcattcctactccacttattcaatggcttaaagatggaaagcccatagctagtggtgaaacagaaagaatccgagtgagtgcaaatggcagcacattaaacatttatggagctcttacatctgacacggggaaatacacatgtgttgctactaatcccgctggagaagaagaccgaatttttaacttgaatgtctatgttacacctacaattaggggtaataaagatgaagcagagaaactaatgactttagtggatacttcaataaatattgaatgcagagccacagggacgcctccaccacagataaactggctgaagaatggacttcctctgcctctctcctcccatatccggttactggcagcaggacaagttatcaggattgtgagagctcaggtgtctgatgtcgctgtgtatacttgtgtggcctccaacagagctggggtggataataagcattacaatcttcaagtgtttgcaccaccaaatatggacaattcaatggggacagaggaaatcacagttctcaaaggtagttccacctctatggcatgcattactgatggaaccccagctcccagtatggcctggcttagagatggccagcctctggggcttgatgcccatctgacagtcagcacccatggaatggtcctgcagctcctcaaagcagagactgaagattcgggaaagtacacctgcattgcctcaaatgaagctggagaagtcagcaagcactttatcctcaaggtcctagatgcgaaaaaagcatttgatgaaattcaacattccttcatgagaaaaaccctcaacaaattagggatagaagatacatacctcaacacaataaagactatttatgataaatccacagctaacatcacactaaacaggaaaaagttgaaagcctttcctacaaggtctagcagaagataa

SEQ ID NO: 351 - DNA, 2366 bp, Homo sapiens
  CDS (639)..(2363)
acactcacacccggaccctcaccacctgccaacccctcacaaccagtacagtaaccaaacccgtcaccgtcttttcccagtctctcatccccacaaacgactctccaggccctctggcccatgcgtaccgttcactcacggaacgccgaacctggccgggcccggttgctgctgcggtgttagaaggactccggcgtgtcataggcgaaggcctctgggaaggtggaggccggcagggcggaggcggagcccgggaaggaaaggtggaaccagagggcagaaggcgggacctaaggagaggcgatttttacaggcagggaaagatcagaagggcggggcttgggagagatggagccggaagaaagacgagcgagaaaggggtggggccatggattccaggagacgcttggagtggaagagtgggtgtggaggggcgaggctatcacgaaaagagaggaggaatcagtagtagcgctagctctggttgtgttgctaagagccccaaagacaaagaagtcacagcagaagcccaacagcagcctccttcaggcagtcaggcactagtgcccaactccagaagtcccctacaggcagagagggtgtggacatctcacaccccagcaccagaccacagaaccatgagccaggacaccaaagtgaagacaacagagtccagtcccccagccccatccaaggccaggaagttgctgcctgtcctggacccatctggggattactactactggtggctgaacacaatggtcttcccagtcatgtataacctcatcatcctcgtgtgcagagcctgcttccccgacttgcagcacggttatctggtggcctggttggtgctggactacacgagtgacctgctatacctactagacatggtggtgcgcttccacacaggattcttggaacagggcatcctggtggtggacaagggtaggatctcgagtcgctacgttcgcacctggagtttcttcttggacctggcttccctgatgcccacagatgtggtctacgtgcggctgggcccgcacacacccaccctgaggctgaaccgctttctccgcgcgccccgcctcttcgaggccttcgaccgcacagagacccgcacagcttacccaaatgcctttcgcattgccaagctgatgctttacatttttgtcgtcatccattggaacagctgcctatactttgccctatcccggtacctgggcttcgggcgtgacgcatgggtgtacccggaccccgcgcagcctggctttgagcgcctgcggcgccagtacctctatagcttttacttctccacgctgatactgactacagtgggcgatacaccgccgccagccagggaagaagagtacctcttcatggtgggcgacttcctgctggccgtcatgggtttcgccaccatcatgggtagcatgagctctgtcatctacaacatgaacactgcagatgcggctttctacccagatcatgcactggtgaagaagtacatgaagctgcagcacgtcaaccgcaagctggagcggcgagttattgactggtatcagcacctgcagatcaacaagaagatgaccaacgaggtagccatcttacagcacttgcctgagcggctgcgggcagaagtggctgtgtctgtgcacctgtccactctgagccgggtgcagatctttcagaactgtgaggccagcctgctggaggagctggtgctgaagctgcagccccagacctactcaccaggtgaatatgtatgccgcaaaggagacattggccaagagatgtacatcatccgagagggtcaactggccgtggtggcagatgatggtatcacacagtatgctgtgctcggtgcagggctctactttggggagatcagcatcatcaacatcaaagggaacatgtctgggaaccgccgcacagccaacatcaagagcctaggttattcagacctattctgcctgagcaaggaggacctgcgggaggtgctgagcgagtatccacaagcacagaccatcatggaggagaaaggacgtgagatcctgctgaaaatgaacaagttggacgtgaatgctgaggcagctgagatcgccctgcaggaggccacagagtcccggctacgaggcctagaccagcagctggatgatctacagaccaagtttgctcgcctcctggctgagctggagtccagcgcacttaagattgcttaccgcattgaacggctggagtggcagactcgagagtggccaatgcccgaggacctggctgaggctgatgacgagggtgagcctgaggagggaacttccaaagatgaagagggcagggccagccaggagggacccccaggtccagagtga

SEQ ID NO: 352 - DNA, 731 bp, Homo sapiens
  CDS (307)..(636)
taagccatatatcatgaactttattccaaatgagattgctaacttactgggcaactttaggaaagccccttaacctgtctggggctcagttttcacacaaatccaaaaatccttgcaaaaaaaggggcagttctcgttcaggcagcaggaggcgctgtctctggaggcttaaattcattccccgccctccgcccgctcccgcccgcctttggggcgcaggcgcggtttcgcggattggccgcgcgcgggggccgtcattcggtggcgggtcccggccgcggggctggcgggctgaggggaaaaaagatggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttaggcctcctgaaactacagaaagggtaagtcagttacttgattagtctacctgaggagatttgagggtccattttaagagattagactataacattctttgacagcatggagcaatcaaaagactaggcagaaaagg

SEQ ID NO: 353 - DNA, 939 bp, Homo sapiens
  CDS (307)..(846)
actagggcaagcaggaagagagtcctccttctggaactgaagcaggcagtgtgaagacccatgtggaacaccttaacccgaagcctctctgaccatccagttggcaaagaccctcaggccatgaggactggccaaagacaaggtcttctgtgggaacaaagggtttgaagcgctgagaatgggaccctcaggagaggaagactgtgagaggacgtgcaagggtaaattcctgagccccgcagtcttatttcctgccctgacgtccctgcataccagcccaagggttaaccgtaagctgatgcctgtatggcggccttactgatgccacgcaggaacaaagggatgaggactcgactgggatgcctgtctcacaagtcagactcgtgtagtgatttcacagctattcttccagacaaacccaaccgcgctctcaagagattatcgacagaagaagctacgaggtgggcagattcctttgatgtgcttctctctcataagtatggggtggctgcattccgtgccttcttgaagacggagttcagtgaggagaacctggaattctggttggcctgtgaggagttcaagaagaccaggtcaactgcaaaactggtctctaaggcccataggatctttgaggagtttgtggatgtgcaggctccacgggaggtaaacattgacttccagacccgagaagccacgaggaagaacctgcaggagccatccctgacttgctttgaccaagcccaaggaaaagtacacagcctcatggagaaagactcttaccccaggttcctgaggtccaaaatgtacttagatctgctgtcccaaagccagaggaggctcagttagacctcagaagggaactcctggaaatcaccggctttcccctccacttgctgccaagatcatattctaatgtgaaatgtcaaaaaaaaaaaa

SEQ ID NO: 354 - DNA, 2138 bp, Homo sapiens
  CDS (143)..(850)
agggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtaccacgttgatgagcgaacaatatgcaatggaattgccccagaaaaagatgtagatggatttcatattatcaatattggaagattgtgccttgatcagcattctctcatacctgccactgccagtgctgtttgggaaataataaaaagaacaggaattcaaacatttggaaaaaatgtggttgtggctggaagatccaagaacgtagggatgcctattgccatgcttttacacactgatggagagcatgaacggccaggaggtgatgcaactgtgacaatagctcacagatacacccccaaagagcaactgaagattcatacgcagctggcagatattatcatagttgctgcaggtattccaaagttgattacgtctgatatggttaaagaaggtgctgctgtaattgatgtgggtatcaactatgtccacgatccagtgacaggaaagacaaaattagttggagatgtggacttcgaagctgttaaaaagaaagctggctttatcactccagttccaggaggtgtgggacccatgacagtggcaatgcttctgaagaacacccttctggcagctaaaaaaatcatttactagatcacatgaaaggataaagcaaactgaagtcatgctatttgtttatttgacaaagggtaaaacctttatattttactacaaagctatttatttctacatggtatttattttttcatgggtgaaatcattgtgaatcaattgattcacatagttttatgcatttcctgctaatttattttgagttttaagaaaacaaccaaaacaattccaatgaaaattttagtaacaattgtttattttgagggtatttgttcataacattaaaacaataaagggctcataataaataaatatatttttgacacaattaaatattacatagagtatgtttacaacaaatatcctgtcagccaaatggttacccatataaaatgtaatttaggttttgctacttgcatgctaacatttttaatgtattttatgatctatgtcatatattaaaaaagagcttgcttactacaagaaaaatattgaaatattgaaaatattgaaaatattattattgaaaataaaatcttgatctcaactatcccccaaatgcatcctataagtccatcctaatgagaaatgatgttctatttaaggaaaggaaaatattccgggaaggcaaaaaatgcagtgctgtttggaagtgtaatgattttatcacatggtgaatgactactaagagtaatgattatatcacattgtgaatgactacttgccacagtaaaaatacatgaagaatgtgttaggtttaaacgtcgtttctttcttctaaaaaatatttggttagtaccttcactgagcaatagtggaaaaataaaaaaataagtaaacagaaaaaactaaagttgtattttcccacaaatatagtatgaatgaggtcatattaaagaacagcaactgttaatgtttgttcacaaattcagaaatctaataggaaaaatgatactttcaatgtgccaaaactaaaccttagtatacaactaaaaatctcctgccttcttgcctacctgtcttccctcttctgttacagaatttgttcctcaaagtagatgcaatgtttctaacacaatttaaattaggaaatatatatgaatgtcgttgaagtctattttgagactgctaaagctattaattgatactgtgtttttatgcccaaatcccagtatgtttatgtaccaataatgactcttacccagcgcatgtctttatcagtgtgtactcgtgacgatttgtgtgaaaatagacttgatgtttataattaataccattacaactgtataataaaagcaatttgaag

SEQ ID NO: 355 - DNA, 2226 bp, Homo sapiens
  CDS (211)..(1212)
agagtcgagagtgggagaagagcggagcgtgtgagcagtactgcggcctcctctcctctcctaacctcgctctcgcggcctacctttacccgcccgcctgctcggcgaccagaacaccttccaccatgaccacctcagcaagttcccacttaaataaaggcatcaagcaggtgtacatgtccctgcctcagggctgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcgggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttcttttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtacgtatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttggctaaaggaaaaaaccatccaggtcacggggcaccaaatttgagacaaatagtcggattagaaataaagcatctcattttgagtagagagcaagggaagtggttcttagatggtgatctgggattaggccctcaagaccccttttgggtttctgccctgcccaccctctggagaaggtgggcactggattagttaacagaccaacaccgttactagcagtcacttgatctccgtggctttggtttaaaagacacact

SEQ ID NO: 356 - DNA, 683 bp, Homo sapiens
  CDS (326)..(631)
gaccggccggattcccggggtgttctgtgaagttttcaagtgcaatcgaaagcctgcagagaccaatttgaggcacacctgtaaacggataagggacatggtgagcaaccagcacccctggtttggcatggagcaggaatatataatctcatggggacagacgggcacccctttggttggccttccagtggattccctgagccccagggtccatcttaactgtagtatgtgagcagacaaaacctatggcagggacattgtggaggctcattaccgggcctgcttgtattctggagtcaagattgcagggactaatgctgaggtcatgcctgcccagtggaaattccaaatcggaccctgtgaaggaatcagcatggaagatcatctctgggtgacctgtttcatcttacatcgtgtatgtgaagacttcggagtgatagcaacctttgatcctaagcccattcctgggaactggaatggtgcaggctgccataccaacattagcaccaaggccatgcgggagaatggtctgaaatacattgaggaggccatcaagaaactaagcaagcaacagcagtaccacatccacattcccatgaaacttctaacatcaacgacttttctgctcttatagcccatcatagtgccagcatacacattccccagacctcagaacaacgaca

SEQ ID NO: 357 - DNA, 1082 bp, Homo sapiens
  CDS (303)..(881)
tttcgtcgcagggcgggggtggggcaccgggtgacgaagggctgccgagaattaacccccgaaccgccgcgagctgtccctagcagtgccttagccagggacctgcttggccagcgacagatcctttgctgctctgtctgccggttcttgaggtgaatgtcggaatccattatctttcgggaaagctctctggggcagggagcgtcctggggagttggaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaggtattccggcagaagttcaggcagtttagttactctgactccactggccctcgggaggctctgagccggctgcgagagctttgctgtcagtggttgaggccggaggtgcactccaaggagcagatcctggagctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattcaaaaaaaaaa

SEQ ID NO: 358 - DNA, 1232 bp, Homo sapiens
  CDS (323)..(937)
gcagccacttgagatcaccaggcctcctgtagaccggcgggtgcagggcccggtcccagagttaagggtgaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgttcctccatgcaacttgatactcctgaaagaggtttttcccttcggaaagatggccctttggacttggagattcggtgggtgggcgatcaaccgggcctgtgatttatgtcctagaaacctaagggggggagaaacgttgccaaaaaagggtttgcattgttcgggccgtgattacccgaaccgaacctagatggaacgagtgtgggcgaatgtgaaattcccggaggtcctcttcatgtgcatgcgcccgtagacgagggtgtaccgctgaatgagagaatgagcgatcacagcagaatcgatcatatggaagaacaacgcagaaaagaagaggtgaggactcagaagaagagtgagcagcacagaaggccgtcgacacgcctctctcttcttt

SEQ ID NO: 359 - DNA, 2816 bp, Homo sapiens
  CDS (228)..(2813)
aggaacacggttctgcctcggaaggcgagtttttaccattgcaacacaaagaacagaggagcgcgctttcacatcgttgcaacttaactcacttgaccagctctatacttcagcaccacggagagcggtacatccttggctaccacccatggggagccagcttctggcgactcaacaccggattccggtcatctagaggaggaacaagcctgcgtattacaccctcaatgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcctatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 360 - DNA, 363 bp, Homo sapiens
  CDS (1)..(360)
atggccagctggattgccaaacctaccctgcggtcctcgtcttcctggccccatagctcctcctcaccaagcatgtcttccccactgcagagagctgcgggaggtaccaagagggccttgtctgcatcttctagttcctctgccagtctacccttcgatgacagggactcaaaccatccctcagaggctgatgaaggcaatgactttgaagacagcttgaatcacagtgtgaagaagaaagcagcaaaacgaccaccaaaagcaacaccgatggcaaacatccagagaaagggtcccgagtggtacatcgtcatagccggaaacagtcagagccaccagccaatgatcttttcaatgctgtga

SEQ ID NO: 361 - DNA, 462 bp, Homo sapiens
  CDS (1)..(459)
atggcccaaatagctgcacaaggatccaacacttccaccttcagcttgtattacaacaataccagcctttcaagctactccggctggattgccaaacctaccctgcggtcctcgtcttcctggccccatagctcctcctcgccaagcatgtcttccccactgcagagagctgtgggagataccaagagggccttgtctgcatcttctagttcctctgccagtctacccttcgatgacagggactcaaaccatccctcagaggctgatgaaggcagtgactttgaagatagcttcaatcgcaatgtgaagaagaaagcagcaaaacgaccaccgaaaacaacaccggtctcatatcccacctcgctgctcctgcgcctgcagtcccccatgtctgcgacacccagtgtcacagcacccctcattgttaccacctcccatctctctccctcacagctccagtaa

SEQ ID NO: 362 - DNA, 1792 bp, Homo sapiens
  CDS (32)..(1354)
gaattcccgggtcgacgatttcgtccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttgacttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgcccctgtctctaaaaaaaaaaa

SEQ ID NO: 363 - DNA, 4269 bp, Homo sapiens
  CDS (389)..(2272)
actcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaattatgccatacaacagtgcccaccactgcgttgtggaggtggaaaacttcttgttcgtgttgggtggagaggaccagtggaatccgaatggaaaacacagtacaaattttgtcagccgatatgatcctcgatttaatagctggattcaacttccacccatgcaggaaagaagagccagtttctatgcatgtcggttggacaagcatttatacgtaattggtggaaggaatgaaactggctacttgtccagcgtggagtgctataacctagaaacgaatgaatggcgctatgtgtcctctttgccacagcctctggcggctcatgcgggagcagtgcacaatgggaaaatatacatttcagggggtgtacacaatggagaatatgtcccatggctatattgctatgacccagtaatggatgtctgggctcgaaaacaagatatgaacacaaaacgtgcaattcacactttggctgtaatgaatgatcgcttgtatgcaattggaggaaatcatttgaaaggtttctcccaccttgatgtaatgcttgtggaatgctatgacccaaaaggtgaccagtggaatatactccaaactcccattttggagggtcgaagtggccctggctgtgcagtgcttgatgacagcatttaccttgtgggaggctacagctggagtatgggggcctacaagtcatctacaatatgctattgtccagagaaaggaacctggacagaactcgaaggagatgtagcagaaccgttggcaggccctgcctgtgtgacagttattctgccctcttgtgtaccatacaacaaataacaccaggaaactctggaatgaacagtatcacattctaggaagcaatggcaggtgacatcactattataataggaacaatgcattctaatggtacaactgccaaaacccacccttggtttctgatgatttataagtaactacaaaagaaagagacctgttcttgaacagatactatgtctataactcagatcgcaccaaacttcctgtggtgacagactcttccatttcagactggttttaacttatcccagctttacaaaaactcttcatgtgaatcttaacttgcaaaaggagaaagataaaatacagaagactggccccagagagacctcagatcagtattgtgcattgtagtctacctgcatgtgatctatgttgacatttcggggatattgtgttcaagaatgattccaaatttgagccaccaaaatacactgcattacagaaattgccacttgattctgtactcttaacctttggctacttcacagactccattggcaacactgttattgaaaatcatgtaagattaaagagaggcattttcgtttctatacaacttcatttcatacaccttctgcccttacagcacctcatgggatcagaaaagagaaagatgttggctcttgtaataaatgctttctaccctataggttctaggctagacagagtcgtcatttctgtgtcctcaattttatctgaaagattaaaacaaaatatattatgtcactattcagttcatggaggtttgtgctttttcatattttgtgatatataagtagtgaacacacatgttatttacttcaaaagacaggattgacaaattcagtcaatactattttagagattctgttagatgatatgtctgacccaaatttaatccataataaaaaaaaatgggagattgttttcaggaattcagggatgaaaagaaagaataatttccattaagtagaattccagttgtctttctgtttctaaaacacagaacttacaagagccacaggagccaattatagcacctgacagaatacttctcctcttcctcaccttcgggtgcctctagacacttgacttacgatcgttattcccccaattcatcatattttgtttgttatcaccagagatgcctgaactcagttaagcgagcaattgctagttgtcttgaggagcatgaggaattcaggagcagaaggtcaggatagcatgagatagtctcaatgtggccaaccaaaaggacaaaactgacaggaatgcacattcgattttcaagccctccagagcttgaacaacaactttaggagtaaataaaagcctaaaatatattttaaccatccagagatggtgttgaatccttcaacaaatgtgtcattcaaaacagtaattagggaaatcccacagatgaaaaatgccttagtgataagctttcatggcagagcacgtcaagataaatgggtatactggaatccgatgccgtttctacagtaaagtgcaatcttcgttgtttttgtatttatttgtatgttcagatccaaaggatccgttgtaaaaatatatatatataaatatatgtatatccagtgcaatcaactgtcatttctttttccttaaaacatatgagtatatagaaagaaaagttacagtactctgtgggaaaatctcagctgacatcatgaatagaatgaggtctgcttcagaaccttttgttgtcaactgtcactgtttcttccaaaagtcacaatttgtacaagaacctttgctttccttagacttgttctgcattttattttttatttctcaccaaaataaaagcatttatgagaattataagtaaagctttctgtatttcagagagacataagttactagaaagtgaaaagtgaataaataagtcacagagaatgtaaattttgtacagtattagaatgtgtaaatgaagcttgcttggaaggggaaaactttaaataaaaactttatgtactaaaaaaaaaaaa

SEQ ID NO: 364 - DNA, 943 bp, Homo sapiens
  CDS (84)..(494)
aaacacagattagaaatattgtatagcactgacctagaaacctccatttaggtaaaacatcttaacccctttggaagcaaaatatgttaaataacagcataaactcccaccaagaaaatcctcaccttcctcctttcaacacatttattatatacagctgtcactgcattgtcaatctgccaaatggctctatgttccaacagggctggagtagtcccctgctcacaccagccttcacaatacttcccatgtcttccctgttaacctctctccacccagcacccaggctcccaactctcctggctgcctccagccctcagctggcaccactgacatgctgtttccagtacccttttcttctttctgcatcctccctgggggacatacatccctcatctcgtgacttcagctgtcacataaattcaaatgtttcagaactctattttttacctcctacatctgtcagtttaaatgtcaggatattttactttcagtaaagccctaaaaagacaaatctatgtacttttaaagaataaaagaaatgactggctgcagctcaaacctacaactgcttgcgaaactctacaatgtctggcagatgctagaaagaaggggatcaagacagagcacacttggcgtggtatgctatctatagaaaatgttaaaataaaattaagtaatctaggtttcctctctttattttctacatctactctctgaagagggcaataaataaggaaatgtcccaaagagggacaaattaagtcccaaaataacacaaaattgggcaaatccagtcatgaagaaagaacagaggttcttaaattgggacacacagaggcaggtctgcaggtctaggaatctctgaacatatgtgcaaaattctgggtatgtgtgcatatgttatataacaaagcgaagggtccatatagctttcatcact

SEQ ID NO: 365 - DNA, 2574 bp, Homo sapiens
  CDS (130)..(2571)
gcacgaggtggaggacgcggctgcttcaagtccttggctctgatccaggccacagattccaggattctacaggcaggaaacatcttagaaatcagggttgggcaggcaggagccaggagagtagctacaatgacttcaccagtactggtggacatacgagaagaggtgacctgccctatctgcctggagctcctaacagaacccctgagcatagactgtggccacagcttctgccaagcctgcatcacaccaaatggcagggaatcagtgattggtcaagaaggggaaagaagctgccctgtgtgccagaccagctaccagccagggaacctgcggcctaatcggcatctggccaacatagtgaggcggctcagagaggtagtgttgggccctgggaagcagctgaaagcagttctttgtgcagaccatggagaaaaactgcagctcttctgtcaggaggatgggaaggtcatttgctggctttgtgagcggtctcaggagcaccgtggtcaccacacgttcctcgtggaggaggttgcccaggagtaccaggagaagtttcaggagtctctaaagaagctgaagaacgaggagcaggaagctgagaagctaacagcttttatcagagagaagaagacatcctggaagaatcagatggagcctgagagatgcaggatccagacagagtttaatcagctgcgaaatatcctagacagagtggagcaacgggagctgaaaaagctggaacaggaagagaagaaggggctacgaattatagaagaggctgagaatgatctggtccaccagacccagtcgctgcgagagctcatctcggatctggagcgtcgatgtcaggggtcaacaatggagctgctgcaggatgtgagtgatgtcacagaaaggagtgagttctggaccctgaggaagccagaagctctccctacaaagctgagaagtatgttccgagccccagatctgaaaaggatgctgcgagtgtgtagagagctgacagatgtccaaagctactgggccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttga

SEQ ID NO: 366 - DNA, 1148 bp, Homo sapiens
  CDS (138)..(983)
gaggcggataaaaaggccccaggacgcccggggagggagcccgttagcgctgcgtccgccgtcggacgcccgcccgagccccgtgactgtccgcgctccatctggtatcttggcctcatgctgtccttgaagtcaccatggcgtggtccccaccagccaccctctttctgttcctgctgctgctaggccagccccctcccagcaggccacagtcactgggcaccactaagctccggctggtgggcccagagagcaagccagaggagggccgcctggaggtgctgcaccagggccagtggggcaccgtgtgtgatgacaactttgctatccaggaggccacagtggcttgccgccagctgggcttcgaagctgccttgacctgggcccacagtgccaagtacggccaaggggagggacccatctggctggacaatgtgcgctgtgtgggcacagagagctccttggaccagtgcgggtctaatggctggggagtcagtgactgcagtcactcagaagacgtaggggtgatatgccacccccggcgccatcgtggctacctttctgaaactgtctccaatgcccttgggccccagggccggcggctggaggaggtgcggctcaagcccatccttgccagtgccaagcagcatagcccagtgaccgagggagccgtggacggcgtgcaccctgacggccaactggccggaaagtgtgtgaaccagcgctggcccatgaacaacaagacgggcggcactccggacatgcatgcgcacaccaagcaagggatccaggtagaccagcccacatacacgagaaacacctgtggacctcaccgactcagtgaacccaacgacacggccgacaaccctgccgcccacctacgaccacatcaggagacagccaagacaaccacccgtggcgggacaaagcccgcaactggcacacccccacaggccaaggtggacctaccacaggagcaagattgaccaagacagcaccaggaagaaactcgtgatcacacaggcaagcagaacgcagcgcgaacacaaccacaaccacaccagacgagaacaagcagcagaagcacactacacagcgacgacacacgccacagccgccgcacacacgaagccccacgcaacacgcag

SEQ ID NO: 367 - DNA, 1850 bp, Homo sapiens
  CDS (274)..(1236)
gattacgcctagcttggcacgagggatcacttgactccatcccctccccaccaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcaggtgaggtcctgatggaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcaaaaaaaaaaaaaa

SEQ ID NO: 368 - DNA, 953 bp, Homo sapiens
  CDS (162)..(746)
ggcacgagggcggagtctgcggccgttcccgcggcctcctcctcctccccgttcccttcacccccaccccgcacccctttccccatcccggctccgtcaccctcccgtcccccacactcaggacaagaatgccctgcccggaacaacccagcagcgcctagatggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaaaaaaaaaa

SEQ ID NO: 369 - DNA, 1029 bp, Homo sapiens
  CDS (433)..(1026)
cccagcgtcgaggagaaagaatcctgaggcacggcggtgagataaccaaggactcttttttactcttctcacacctttgaagtgggagcctcttgagtcaaatcagtaagaatgcggctcttgcagctgagggtctggggggctgttggggctgcccaaggcagagaggggctgtgacaagccctgcgggatgataactttaaaagggcatctcctgctggcttctcacttggcagctttatcactgcaagtgacagaatggggagggttctgtctctcctgcgtgcttggagagctggggggctataaaaagaggcggcactgggcagctgggagacagggacagacgtaggccaagagaggggaaccagagaggaaccagaggggagagacagagcagcaagcagtggattgctccttgacgacgccagcatgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggacccagcagcagtttcacttcttctggttggacatcggggcaatctgtgtgtggggcaacttcctaaacaccaggaagaaacagaatggattccccatccgctgctcctccaggacgcggctgctagcaggaggagatgaattctag

SEQ ID NO: 370 - DNA, 2820 bp, Homo sapiens
  CDS (1)..(2817)
atggtggtgaatgccctggtgtttctttttgtcccttatatcctgggccgcatacttgagaagccaacaacctggaaccaccagtgggctcagacacacgcatgtgcacccaggatggtgccagcagagccccacttgaagcgccaactcccaccgatccccagcaataatgaggcaccctccctgttcccgggtgtccatggaggccacgtggggaacccggacttccactctcatctagcagaagttctcgccgttcagttgctggctgggtccctgctcttctcagccagggccatgccgcaggccagcacagcagccatttcccttttggctcctaccagttttgccccttttcctgatgatatttctcagggcatactttcatcctctactgcacatcaaggcagcccccaggggtggcaaaagctgctgtttttcacagccatccctaataaaaccactgtgatggtcacggtggagccccaggacatgacagtgagatctggggatgacgtggccctgcggtgccaggccactggagagcccacacccaccattgaatggctacaggcgggtcaacccttgcgggccagccggcggctccggaccctgcccgatgggagcctgtggctggagaacgtggagactggggatgcaggcacctacgactgcgtcgctcacaacctcctgggctctgccacagcccgggcgttcctggtctgtgccagccacgccatcgtgggctcccggcatttcagagacccacaggtcttctgtgagtttgtggtcccgcctcctcattttacaggggagccccaggggagctggggcagcatgactggggtgataaatggccggaaatttggcgtggccacactcaacaccagcgtgatgcaggaggcacactccggggtcagcagcatccacagcagcatccgccatgtcccagcaaacgtggggcctctgatgcgggtgctcgtggtcaccatcgcccccatctactgggccctggccagagagagtggggaagccctgaatggccactctctgactgggggcaggttccggcaggagtcacacgtggagtttgctacaggggagctgctcacgatgacccaggtggcccggggtctggatcccgatggcctcctgctcctcgacgtggtggtcaatggcgttgtccccgagagcctggctgacgcagatcttcaagtgcaggactttgaggagcactacgtgcaaacagggcctggccagctgttcgtgggctccacacagcgcttcttccagggcggcctcccctcgttcctacgctgcaaccacagcatccagtacaacgcggcccggggcccccagccccagctggtgcagcacctgcgggcctcagctatcagctcggcctttgatccagaggccgaggccctgcgcttccagctcgctacagccctgcaggcggaggagaacgaggtcggctgccccgagggctttgagctggactcccagggagcgttttgtgtggacagggacgagtgctcaggaggccctagcccctgctcccatgcctgccttaatgcacccggccgcttctcctgcacctgccccactggcttcgccctggcctgggatgacaggaactgcagagatgtggacgagtgtgcgtgggatgctcacctctgccgagagggacagcgctgtgtgaacctgctcgggtcctaccgctgcctccccgactgtgggcctggcttccgggtggctgatggggccggctgtgaagatgtggacgaatgcctggaggggttggacgactgtcactacaaccagctctgcgagaacaccccaggcggtcaccgctgcagctgccccaggggttaccggatgcagggccccagcctgccctgcctagatgtcaatgagtgcctgcagctgcccaaggcctgcgcctaccagtgccacaacctccagggcagctaccgctgcctgtgccccccaggccagaccctccttcgcgacggcaaggcctgcacctcactggagcggaatggacaaaatgtgaccaccgtcagccaccgaggccctctattgccctggctgcggccctgggcctcgatccccggtacctcctaccacgcctgggtctctctccgtccgggtcccatggccctgagcagtgtgggccgggcctggtgccctcctggtttcatcaggcagaacggagtctgcacagaccttgacgagtgccgcgtgaggaacctgtgtcagcacgcctgccgcaacactgagggcagctaccagtgcctgtgccccgccggctaccgtctgctccccagcgggaagaactgccaggacatcaacgagtgcgaggaggagagcatcgagtgtggacccggccagatgtgcttcaacacccgtggcagctaccagtgtgtggacacaccctgtcctgccacctaccggcagggccccagccctgggacgtgcttccggcgctgctcgcaggactgcggcacgggcggcccctctacgctgcagtaccggctgctgccgctgcccctgggcgtgcgcgcccaccacgacgtggcccgcctcaccgccttctccgaggtcggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtcttcgtcttgctcatcgccgtgtccccctacccctactaa

SEQ ID NO: 371 - DNA, 588 bp, Homo sapiens
  CDS (147)..(413)
ctcccagaaggattttccctggatgatccactaacacaccctttccgagatgttttctcaagggcctccattgtcttcagcatcctctcatctctttcctgtcccttttcccagctgttgtcacttctccctcccaaagctcccagatgcctgagcccttcggaacctcgtgcaccctggactggtggctggcccaggcctcggtagggggccaggttttcatcctgaacatcctcttcttctgcctcttgctcccaacggctgtgatcgtgttctcctacgtaaagatcattgccaaggttaagtcctcttccaaagaagtagctcatttcgacagtcggatccatagcagccatgtgctggaaatgaaactgacaaaggtaagtgcactaatattttacacatgtgttttctgactacttacaacttcatagggtacaaaggatagggaacgttggagactgagagaacttagaatctctattctttacgtaattctgaacttcgttgatgattgtctaagcctttctttgtggtatctctctcctctttctgtctctgtacccccacttctctcttctctctctc

SEQ ID NO: 372 - DNA, 1089 bp, Homo sapiens
  CDS (552)..(842)
attttcgggtcgacgttccgtgcgaggcttgagctgacactgcgggaagcagaggcatctgccgtgcacagagcctggcgagcatattccaggcttgaggaggggtcctaaggcagggagaagttggcgagtgggcagggctgtgctttgagggctgacattggacatggggtttcactgggcccaaatcctatggcgctttacaggccccagtgaggaactttgttcctagggcagtgcggagccaccaaaggctttgagtgggagaggggcctgatctgaatagtgacattgaaagctctatctggcttcggggccacaggggattgaatggggtctggagggcagatcagcagagagggtgggggtggctcagaatcacagtcacctgtcctgaatgtccatgtccatgctggatgtcccctgcccaacacccacccaggctgggctgtggggtcagcacctggccgggccaggaggtggcctgtgagtgaccacccccggggaggtggacgagtccctaatgtttccctcgctccccaccagggcccatgtgtgacctgctctggtcagatccacagccacagaacgggcgctcgatcagcaagcggggcgtgagctgtcagtttgggcctgacgtcaccaaggccttcttggaagagaacaacctggactatatcatccgcagccacgaagtcaaggccgagggctacgaggtggctcacggaggccgctgtgtcaccgtcttctctgcccccaactactggtatgtctttgcctttccagcccagggcctctaccaagccacgggtttttgtcttggtttttgttttgcctttttatgatggaacatttcaaagacaggcaagagcagataaaagaacatgatgaacacccccgtatgtgtcacccacccatgcagcaccagtggggccagcctgtgagcgctgaccagctgccctgtgttacagcaagcccctggcacttcacctttctcccactgattgcccagcacttttcagaaggaaagggatctttttcttaaccacaatatcgtgtttacacttttgagtgctggctgggcatggg

SEQ ID NO: 373 - DNA, 2980 bp, Homo sapiens
  CDS (830)..(1846)
gggccgtggtgcagcgcgtcacccgggccagcgtcacagttggaggagagcagattagtgccattggaaggggcatatgtgtgttgctgggtatttccctggaggatacgcagaaggaactggaacacatggtccgaaagattctaaacctgcgtgtatttgaggatgagagtgggaagcactggtcgaagagtgtgatggacaaacagtacgagattctgtgtgtcagccagtttaccctccagtgtgtcctgaagggaaacaagcctgatttccacctagcaatgcccacggagcaggcagagggcttctacaacagcttcctggagcagctgcgtaaaacatacaggccggagcttatcaaagatggcaagtttggggcctacatgcaggtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaaggaaagaaacactccccgaaaagaagaccgcagtgccagcagcggggctgagggcgacgtgtcctctgaacgggagccgtagctcaggaggcagaattcagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgtgttgaagtgtcaagagagcaatcatcaatgataatgtattgtgtgagacctttgcatcttgtaaattttctcttttttctaaaaataaataataataaaatccggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaataggcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagaaaagacggggtgtggcgggggtaggtgggcgaggaacctgggatgcaaaccagtgtttggggccaggagtggctgtatggtttcagaggcgcccaccactctgggtttgagggacacagcaccctcgtctcggcgctttggattgtcacgcaccagaccacggggcggaggaatggagtggcatccctggggggagttaagacacacgaggtttgcagtttcattttgtttcagaatcagtttggccataaaaatggactgggttggggacaggcggagcgattgaaccaccggagatgaggaggaggtggcaggcgcctctcctggggtggggactgagggctgtggagacagtaccatggtgaaggaccccatggcaatgggagtattgcactgagccaggtttcgggggaacggggacgtgtcgggatggcgtagggggacagagcctggcaggagacacatggaagtttccgccttgtcagtctcagagcaaacgccttttagtctttacagtacaggaatttggacactgcccacgttctcagtggacagcagccatcagaggtgacccaggagggaagtgggcattggtcaccaaggtatttacagacttctatcatgggggacagcggggtgggtccagcagcctccctcgcgggggatctgagggagaccgagttcgctaaatattataaataggtcttgccgtcctcctgcccccgcccctcggcacagtcagtggagcacgtcagcctcggtttacagttctctgaaaaggaaccaaaaaacacaaccaacaccaagtatatctccaaaggggccttggagacaacacaagaatggaaatgaaatgctcgtgcc

SEQ ID NO: 374 - DNA, 1692 bp, Homo sapiens
  CDS (1)..(1689)
atggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcccgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggctcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatagacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaagcgggtctggcctttactggtgaagtgctcactgcctttctggtgggccagtccgtttatgagcaaccctga

SEQ ID NO: 375 - DNA, 1958 bp, Homo sapiens
  CDS (180)..(923)
gagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattctgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacactatcttacagcaagtgaacaggggctacctgccacatcccctccacagatgcactttaaaaagccactcaagctttggcttaaactgtaattaatttattttatgtacaataaatcgcatttgaaaaaaaaaa

SEQ ID NO: 376 - DNA, 4836 bp, Homo sapiens
  CDS (290)..(3883)
cggcgcctcggcctcggccgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataaccccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcaaacaaacaatgcaaacggggcaggggcgggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaaagaaaaaggaaaaaaaaaaagtcaataacaaaaaacccagctcaagaacccattctacgccaaactggaaaggaaaaaagagcaacaggaagattccaaaaacggggggccccagtttttgaagaactttatgaacttttcaaagattattttcatatggcagcaagtgatacggaaaactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggcaggctgctggaaggccccgggggcgcggggcgagtttacttttactgagcacctctggataaatccctaagcaacgtggtttctcaaatgtcattaataatgttgtgttgcaaacttagggtcacatccctctctgaaaatgtatttctccttgggaatccacccctagtacgcgtagcgtagggctagggtcgtcaacagaacaccctagtagaatgtacgcactacagcaccttgtttcctacattgtgttcaactccaagatccaataggat

SEQ ID NO: 377 - DNA, 4755 bp, Homo sapiens
  CDS (290)..(3802)
cggcgcctcggcctcggccgctccgcccgcccggccgccccgagccccgagccccgagccccccgcgccgggcccgggcggcagcggcggcggcggcggcggcggcgcgcccggccccctcccccggcgccggccacgggaggcggtgatgcgggcgcgggcggcctcggctgcgccgagagcggagacacaggctcaagatggcagattccgactgaggctgggggggccgagctcgcgcgccgctttcccgtccccgttgccatgaaccgcggacaccccggccccgatggcccccgtgtacgaaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgcccctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgactttggttcagccagccacgtctccaaggctgtgtgctccacctacttgcagtccagatattacagggcccctgagatcatccttggtttaccattttgtgaggcaattgacatgtggtccctgggctgtgttattgcagaattgttcctgggttggccgttatatccaggagcttcggagtatgatcagattcggtatatttcacaaacacagggtttgcctgctgaatatttattaagcgccgggacaaagacaactaggtttttcaaccgtgacacggactcaccatatcctttgtggagactgaagacaccagatgaccatgaagcagagacagggattaagtcaaaagaagcaagaaagtacattttcaactgtttagatgatatggcccaggtgaacatgacgacagatttggaagggagcgacatgttggtagaaaaggctgaccggcgggagttcattgacctgttgaagaagatgctgaccattgatgctgacaagagaatcactccaatcgaaaccctgaaccatccctttgtcaccatgacacacttactcgattttccccacagcacacacgtcaaatcatgtttccagaacatggagatctgcaagcgtcgggtgaatatgtatgacacggtgaaccagagcaaaacccctttcatcacgcacgtggcccccagcacgtccaccaacctgaccatgacctttaacaaccagctgaccactgtccacaaccagccctcagcggcatccatggctgcagtggcccagcggagcatgcccctgcagacaggaacagcccagatttgtgcccggcctgacccgttccagcaagctctcatcgtgtgtccccccggcttccaaggcttgcaggcctctccctctaagcacgctggctactcggtgcgaatggaaaatgcagttcccatcgtcactcaagccccaggagctcagcctcttcagatccaaccaggtctgcttgcccagcaggcttggccaagtgggacccagcagatcctgcttcccccagcatggcagcaactgactggagtggccacccacacatcagtgcagcatgccaccgtgattcccgagaccatggcaggcacccagcagctggcggactggagaaatacgcatgctcacggaagccattataaccccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgagaaatgtctccacctgtgaggtgtcctcctctcaggccatcagctccccacagcgatccaagcgtgtcaaggagaacacacctccccgctgtgccatggtgcacagtagcccggcctgcagcacctcggtcacctgtgggtggggcgacgtggcctccagcaccacccgggaacggcagcggcagacaattgtcattcccgacactcccagccccacggtcagcgtcatcaccatcagcagtgacacggacgaggaggaggaacagaaacacgcccccaccagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccagtcaacaccagtcaccactcgtcctcctacaagtccaagtcctccagcaacgtgacctccaccagcggtcactcttcagggagctcatctggagccatcacctaccggcagcagcggccgggcccccacttccagcagcagcagccactcaatctcagccaggctcagcagcacatcaccacggaccgcactgggagccaccgaaggcagcaggcctacatcactcccaccatggcccaggctccgtactccttcccgcacaacagccccagccacggcactgtgcacccgcatctggctgcagccgctgccgctgcccacctccccacccagccccacctctacacctacactgcgccggcggccctgggctccaccggcaccgtggcccacctggtggcctcgcaaggctctgcgcgccacaccgtgcagcacactgcctacccagccagcatcgtccaccaggtccccgtgagcatgggcccccgggtcctgccctcgcccaccatccacccgagtcagtatccagcccaatttgcccaccagacctacatcagcgcctcgccagcctccaccgtctacactggatacccactgagccccgccaaggtcaaccagtacccttacatataaacactggaggggagggagggagggagggagggagagaatggcccgagggaggagggagagaaggagggaggcgctcctgggaccgtgggcgctggccttttatactgaagatgccgcaaacaaacaatgcaaacggggcaggggcgggggggggggggcagagggcagggggacgggtcgggacaccagtgaaacttgaaccgggaagtgggaggacgtagagcagagaagagaacatttttaaaaggaagggattaaagagggtgggaaatctatggtttttattttaaaaaaagaaaaaggaaaaaaaaaaagtcaataacaaaaaacccagctcaagaacccattctacgccaaactggaaaggaaaaaagagcaacaggaagattccaaaaacggggggccccagtttttgaagaactttatgaacttttcaaagattattttcatatggcagcaagtgatacggaaaactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggcaggctgctggaaggccccgggggcgcggggcgagtttacttttactgagcacctctggataaatccctaagcaacgtggtttctcaaatgtcattaataatgttgtgttgcaaacttagggtcacatccctctctgaaaatgtatttctccttgggaatccacccctagtacgcgtagcgtagggctagggtcgtcaacagaacaccctagtagaatgtacgcactacagcaccttgtttcctacattgtgttcaactccaagatccaataggat

SEQ ID NO: 378 - DNA, 4449 bp, Homo sapiens
  CDS (383)..(2548)
tttcgtcagagcagcaggcggcatccggggggagcggggccggctggggggccccaggagggcttcctggaaccccagctccatggccgcctgcaccctgacacaggccagataagagtcccggctgcattatcagagcccggcagggcaccggcctccctgcaccagaaggaagactcggggcgcagcaggtcctcaaggcgatcttcccagagagcgggaccagcggctggtggccagtgtggatggaatttgcagagccctagctcgagtccgggagtcccgggccagatgggagcagacgcttgctggcggcaatagggaaagtgaggcagctgcaaggagggcggcgggactgcactcgagtgtccagacctgctcgatggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagcacacctcggccgagagcctgatggagtgcatcctggagagcttcgccttcctcaatgccgacttcgccctggatgagctgtccctgtttgggggctcccagggtctccgaaaggaccggcccctgcccccaccgtcatcactgaaagcgtcatccagggaactcacagccggtgccccagagctggacgtgctgctgatggtacacctccaagtctgcaaagctctgctgcagaaactggcctcccctaatttatcaaggctggtccaggaatgcctcctggaagaagtggcacagcaaaagcacgttctggagacactttctgtccttgactttgagaaggtcggcaaggcaacatccattgaagagagtcctagtggagggaaacctttcgggtccttgtcatgtgctctccccgagtcaccattcaggtttctgaactggggctttcagtcatcccacaggcctcgcggacgaaggggtgcctgaagctgtggagagggtgcacagggcctggcagggtcctgtcctgccctgccacgacgctgctgaaccagctcaagaaaaccttccagcacagagtcagagggaagtacccaggacagctggaaatagcgtgccgcaggctcctggagcaggtggtcagctgtggtgggctgctccccggagctgggctcccagaagaacagatcattacctggttccagtttcacagctacctgcagaggcagagcgtctctgacctggagaagcacttcacccagctcaccaaggaagtgacactcatcgaggagcttcactgtgcgggacaggccaaggtggtccggaagctgcaggggaagcggctgggccagctccagcctctgccccagaccttaagagcctgggcgctgctccagctggacggcactccgagggtgtgcagggcggccagcgctcgcctggctggtgcagtcaggaacagaagcttccgggaaaaggctttgctgttctacaccaacgccctggcagagaacgacgcaaggctccagcaggccgcatgcctagcgctcaaacacctcaagggcattgaaagcatcgaccagactgccagcctgtgccagtctgacctggaggccgtgcgggcggcagcccgggaaaccacactgtcgttcggtgaaaaaggacggttagcttttgagaagatggacaagctctgctcagaacaaagagaagtcttttgccaggaggcagatgttgaaatcacaatattttaaaaaatcctggctgatgagcacaaatctcacatcgttttttttgctgctgcccagcctggacatagcctgcactctgggtaatggtgctgtgcactcctccaggagtgtgagctgcccagagctctacctgagactccggccattgacccagccccagggcatgggctggtcttttgtacagaggcagaaaaaagcaaggcaaaggtacagcattccaggggctgcacggcctcaacagagcgctcaacttctggctgagggtctgtgtgaccttccccgagatgcagagctgagccaaactaggtggccacctacaaaagggccaaggccaggcaagttgaggccctaaataaaaggctccaaggcaagtgtgtagaactccaggcctcgctgccggtcagctgctcggcacttctgcgtcaagaggcactggggatgcagcaggctggcaggtggctggccctgctaatgcaagactgctcaggccatttcagcagcagccaggtgtcaccttggtgagctggggaaggtgggaaggcacaaagccagggtttctacaaccacactctcagcccgactgacttgctgcgagtgctggtggagctcacagacggcggctggtggatggtggactgtgaacctcactttccctatgttcagcagcacaaagggaagaagccaccacatcagcccaggagccctgagcagcacaggcagtagggccactcactttggccatccgcacccaaatgcaatcaatcaacccagcttcggaagctaccctaggatctcgtcaataaactgctaagaagccatcaactggcctaaagaaagagttcactgaagaacgcaattgctttaaagaaagaaaaattagtttcctatttaagtcttaaaaaaaagcaaaccatgtcctgagatgtctgtgttaatagtgcagagagaacctagggtttgaggttgctgtagcaatggcattggagaactttaacttgaacattctcatcgatacttcctggacatattttgtgtttttaacttacttagtatttatttgccttgttcatatgttcaattttctgaaatttcaattaaactattggtgtttcactttttacccaaaaaaaaaaa

SEQ ID NO: 379 - DNA, 1226 bp, Homo sapiens
  CDS (174)..(1223)
ggaattcccgggtcgacgatttcgtgcgacggctgctgtgtctcctggaaagggattcccgaaaggttttattccaaaaggagaggttggaagacatagctcatctcctgctgtgtatcagccaagaaggtgtgaggtggtgttccttggggatccgcttgcatctacttgggatgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcaggtgagacagcgtcagattcagaccctgtctccacaggaaagccaagaaggaattggtgtcattgctgtgaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggtaaatggagctccttatcttgtcattcgtgctctgcttttggaaagtggaacactttcagagataacagatacttttttcagaattcacattttatatggtagaatctacatctgcaaaccacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtga

SEQ ID NO: 380 - DNA, 1362 bp, Homo sapiens
  CDS (187)..(1359)
ggaattcccgggtcgacgatttcgtgcgacggctgctgtgtctcctggaaagggattcccgaaaggttttattccaaaaggagaggttggaagacatagctcatctcctgctgtgtatcagccaagaaggtgtgaggtggtgttccttggggatccgcttgcatctacttggggtggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcaggtgagacagcgtcagattcagaccctgtctccacaggaaagccaagaaggaattggtgtcattgctgtgaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggtaaatggagctccttatcttgtcattcgtgctctgcttttggaaagtggaacactttcagagataacagatacttttttcagaattcacattttatatggtagaatctacatctgcaaaccacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtga

SEQ ID NO: 381 - DNA, 902 bp, Homo sapiens
  CDS (228)..(704)
ccgaaatgcacacgaagtccggaactggtcttctgtgattttcattcgccctggtctctgttccctttcgtactcaaagctcgtgcatccagggaggggaaaccggagatagggtcttcgggccccgggcagaccctctgtgccgctgcaaaccgttgcagcctgaggctgtcaggtcctcccccagacacctgcggaccctccctctcctggcttcccgtctggtcatggcgagattctgggtctgcgtagccggtgctggcttctttcttgcatttttggttttgcattcgcgtttttgtggctctccagttttgaggaactttacttttgcagtttcctggagaactgagaaaattctttaccggctggatgtgggttggcctaagcacccagaatattttaccggaacaacattttgtgttgcagttgactccctcaatggattggtttacataggtcaaagaggggataacatcccaaagatattagtgttcacagaggatggatatttcctacgagcctggaattatacagttgacacacctcatggtatatttgcagccagtactctatatgaacaatccgtctggatcacggatgtggaagtggattcttggtcatactggtacccaatacgctccttgggaactggtcacagtctgggctactccagcaaaagggctaatttgatccttgcaggttgataaccagcgaatttgtggagggcccgcgaacttcctcgtgccgggacgcggcgcctaccatgtcaccggccatcgcagccgggctggaaggacggggcacaaacaccacggacacacgcgcggggggccacaacacacaaaccggcggtataaacacctcacacaacacccagcgcacacacacagtcctgtcct

SEQ ID NO: 382 - DNA, 1326 bp, Homo sapiens
  CDS (658)..(1323)
tccccgtgtctcatcctgtcctcaccctcagctctgctaaggacttgaattttgagggagccaaggtgacacttcactgtgaagcccagagaggttcactccccatcgtgtaccagtttcaacatgaggatgtcaccctggggatccctgtgtctcatcctgtcctcaccctcagctctgctgaggccctgacttttgaaggagccactgtgacacttcactcttcgctgatcctgcaagctccactttctgtgtttgaaggagacttcgtggttctgaggtgccgggcaaaggcggaagtaacactgaatactatgtacaagaatggtaacgtcctgacattccttaataaaagctctgacttccatattcatcacgcaagtctcaaagacaatggtgcatatcactttactggatttaacggaagtaatttctctgtttcttccaacatagtcaaaatccaagtccaagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgccttacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcgggatgttccttgctgagaaaaagaattcagtga

SEQ ID NO: 383 - DNA, 1742 bp, Homo sapiens
  CDS (501)..(1178)
gccgcaggccgctattttgttgcggttcgtacgccttccagctcaccaaaaacagtctcaaaaacaaccatttcctctctgctgagagccagggaaggcgagctctgcgcacacgggcgtccctgcagcagccactctgctttccactgctgcaggcgagaagaggcacgcgcggcacaggccggcctccgcttcccgggaagacggcgcactcctggccatgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctgtgactgtgctggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcctttcctaagttaaataaatgcaagcctctgaactctgtcaaaaaaaaaaaa

SEQ ID NO: 384 - DNA, 6649 bp, Homo sapiens
  CDS (698)..(3334)
gcagcagagccttcgctgacgccaagaggcagggaggcgcaggcagggcgcaggcggcggcgggcggcatggagagcctgctggagaatccggtgcgcgccgtgctctgcctcaaggagctcacggccatcgtgcagaagcagcagagcctcatccacacccagcgagagcgtatcgacgagctggagcggcggctggacgagctgagcactgagaaccgcagcctgtgggagcaccagcagctgctgcaagcccagcctccgcccgggctcgtccccccgtcatcggccccgctgccggccgctccggccaccgctcctgccgccgccgccagggcccaggaacctctccaggaccagggacagcgctcagcagccgcgccgcatcccgcgcccgatcggccgccgcgtcagcaccacggacagctcctggagcagccccagcggggccctggcagcagggctcacacaccccagtcgccccagaagcatctggggacacaaggggccgtgactgacaaggagaaggagcgtcccccgagttgctgcgctgctgccggagccctccttcagcacaaatccccctccgccctcggcaagggcgtcctgagcaggagacctgagaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgacaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggaaagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggctctcagacggtccaggcccccgcagagcccgcggcgggcaaggccgagcagggcgagacctctgggcgggaggccccggaagcccccgccgtgggccggggggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggccccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccatgggatcgcgaggtcatgtatctgcaaaatgcacctttttaaagagtgtcttagttccccagccccagctaatacccggccaatgccgtgtacgcacaggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccagggacactctcccagacagccctgacccgccaggcaggaccccgtcccctgctcacacagctcttcaagcttaccaaggacaggcaggaccccgtcccctgctcacacagctcttcaagcttaccaagtgccctcaacaggggagagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcttgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagaaacctctctagggaaaggcagggtggctgcacccagcaactaatccaaatggcaaatattttgtaacaaaatagcccagaggtattttatctgttcaattcatagagttttagagattatattgaaagatgtcacttg

SEQ ID NO: 385 - DNA, 3161 bp, Homo sapiens
  CDS (107)..(2590)
gctgaggccaccatgtgacacggcgccgcatcgttgtgcgaccaagcagcggcgccctggtgcctctcgtccatgctcctgggccccagccccgcgcaggccaaggatgaggccgaggcccgaaggtagggggctccgggcgggagtcgcgctgtcccccgcgctactgctgctgctgctgctgccgccgccgccgacgctgctggggcgcctgtgggcagcgggcacaccctcgccgtcggcgcccggagctcggcaggacggcgcgctgggagccggccgcgtcaaacgcggctgggtgtggaaccagttcttcgtggtagaggagtacacgggcacggagcccctgtatgtgggcaagatccactccgactcagacgagggtgacggggccatcaagtacaccatctcaggcgagggtgctgggaccatcttcctgatcgacgagctgacaggcgacattcatgccatggagcgcctggaccgcgagcagaaaaccttctacacgctgcgggcccaggctcgggatcgcgccaccaaccgcctactggagcccgagtcggagttcatcatcaaggtgcaggacatcaatgacagtgagccccgcttcctgcacggcccctatattggcagcgtggccgagctctcacctacaggcacgtcggtgatgcaggtgatggcctcggatgcggatgaccccacgtacggcagcagcgctcggctggtgtacagcgtgctggacggcgagcaccacttcaccgtggaccccaagaccggcgtaatccggacggctgtgcctgaccttgaccgcgagagccaggagcgctacgaggtggtgatccaggccacagacatggcgggtcagctgggtggcctctcgggctccactaccgtcaccatcgtagtcaccgacgtcaatgacaacccgccccgtttcccgcagaagatgtaccagttcagcatccaggagtcagcccccattggaacggctgtgggacgtgtgaaggctgaggactcagacgtgggagagaacacagacatgacttaccaccttaaggacgagagcagcagcggcggcgatgtgttcaaggtcaccacagacagcgacactcaggaggccatcatcgtagtgcagaagcgcctggacttcgaatcccagcccgtgcacaccgtgatcctggaggccctcaacaagttcgtggacccccgcttcgccgacctgggcacgttccgcgaccaggcgatcgtgcgcgtggccgtgaccgacgtggacgagccccccgagttccggccgccctccggcctcctggaggtgcaggaggacgcgcaggtgggctccctggtcggcgtggtgacggcgcgggaccccgacgccgccaaccggcccgtccggtacgccattgaccgcgaatcagatttggaccagatcttcgatatcgatgcggacacaggcgccatcgtgactggcaaggggctggaccgcgagacggccggctggcacaacatcacagtgctggccatggaggcggacaatcatgcacagctatcccgggcatccctaaggatccgaatcctggatgtgaacgacaatcccccagaactggccacaccctacgaggcagctgtatgcgaggatgccaagccaggccagctcatccagaccatcagcgtggtggacagagacgagccccaaggcgggcaccgcttctatttccgcctggtgcctgaagctcccagcaaccctcatttctctctgcttgacatccaagacaacaccgctgcagtgcacacgcagcacgtgggcttcaaccggcaggagcaggacgtgttcttcctgcccatcctggtggtagacagtgggccgcccacactgagcagcacaggcacgctcaccatccgcatctgtggctgcgacagctccggcaccatccagtcctgcaacaccacggcctttgtcatggccgcctccctcagccccggcgccctcatcgccctcttggtctgcgttctcatcctggttgtgctggtgctgctgatcctcaccctcaggcgccaccacaagagccacctgagctcggacgaggatgaagacatgcgggacaacgtcatcaaatacaacgacgaaggcggcggcgagcaggacaccgaagcctacgacatgtcggcgctgcggagcctctacgacttcggcgagctcaagggcggcgacgggggcggcagcgcgggcgggggagcgggcgggggctcgggcgggggcgcgggcagccccccgcaggcccacctgccctccgagcgccactcgctgccgcaggggccgccgagccccgagccagacttctcagtgttcagggacttcatcagccgcaaggtggcactggcggacggggacctgtcggtgccgccctacgacgccttccagacctacgccttcgagggcgcggactcgccggccgcctcgctcagctccctgcacagcggctcgtcgggctccgagcaggacttcgcctatctcagcagctggggtccgcgcttccggcccctggccgcgctctacgccggccaccgcggggacgacgaggcccaggcctcctagcccctcgccctgccgtcggggcgcggctgctcacccgcccagcacacgccggggccccaggacaacgcgtttcccccgcggaccccctttcctgccctcccccaaccctcccttggcggctggacggaggggggacttgctaggagcggactcttccattcctcctcctctaggggtgcagctttggagcccagaggtgcgggattctgaccaacggcattaaaactgaggcgagaccgggcacggtgtggctctggggttagaatgggagatgggggtggcgttgcagagtcgggaaggggcgggtcactcaatcctggcctgggggagaatgctggagggagcacgccgctgagatgcccccaccccaggtttcccccatcagagttaagaggaaagaaggctgttcacttactaagcacctactgtgtgctgggacgctgtacagagaccagctcagtcgtcagagaaaccatgaggtggtgtcctgcacggaatagaaggggaaaggaccccagagaagtggctgtgacccgtccaagggcacctggccagtgaatggcagagc

SEQ ID NO: 386 - DNA, 1617 bp, Homo sapiens
  CDS (708)..(1331)
aaaaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggaccgccggggtcctgcttgtcctggggcagccacgagggagccctcgtcaggagcgccatgggccgaagctgcctgccctctgcacgtggatgtttctttggaacaaggggaaaaattatgattttcttattttgctttgacctgtgaatgacaccctggtctctggtgcctggggtgtgctctctgcagtgctgccaggcacatgctggttccttcagcgttaggtgcttggcaccttcagtcttttcctgacgtcatgtttgttcctggtgcctcagataggagacggctgttctgacggctcctgcttccccattcctggagggaagacagacttagccactggtatctgtgggacttcttggaactctgaatgccagaccttgcccagtgctagaggcgacaagtgtgtgaagttgaagaggcttctcccacctgctcagctgcagtggacccgagcgggcagagagagcagagtgcagcaggggccaggctgtgctcgcaggcggggcaggtgcctggagagcatggcgcccctgggagcctctggccaggaagggcatgtgcactgcagtgtgccgtggaccagtggcctcagctcagtgtgttgacgagggtcccaaggcactcacgtgtgtggggatgttagcaacacacggcggggaagccctgatgcagtttctcaccaagcgtgtagcagaccccacgcaccccacacagggcaggcaccccacacagggcacagaccccacgcaccccacacggggcaggcagctcacacagggcacagaccccacgcaccccacacagggcacagaccccacgcaccccacacagggcacagaccccacacaccccacacagggcaggcacctcacacagggcacagaccccatgcatcccacacagggcaggcaccccacacagggcacagaccccacacaccccacacagggcaggcaccccacacagggcacagaccccacgcaccccacacagggcagggatcccacgcagggcacagatcccacgcagggcagggccagcccaaggccaggcccctcccctgtagatctcctcccaggcaggaccagagccacagtcacttccacactatctccttccctagaaacctctgcagactcttcctcctctcctcgatacacaggggcccctgccacagcctgactctctgccacctcgtgagtctctggaaagcagggtcggcctctgaatacagaggacttgggtcctgccggaggatgcttggccagtgggtgctggcacgtgagcagcccccggggagtcagagtggggctgcagcgaaggccgtggtggtcgaggtgagggtggtggccaggtcttgttgccgcagtgaggattctggggttaccctaagagccaccacattcaggcactcaagaaaaagcacgtcaaaataaaatattttcacatgattaaaaaaaaaaaa

SEQ ID NO: 387 - DNA, 429 bp, Homo sapiens
  CDS (28)..(426)
cgagtggctcttctcagcaagtgttccatgatggttgagcccttcttgggaacctggaagctggtctccagtgaaaactttgaggattacatgaaagaactgggagtgaatttcgcagcccggaacatggcagggttagtgaaaccgacagtaactattagtgttgatgggaaaatgatgaccataagaacagaaagttctttccaggacactaagatctccttcaagctgggggaagaatttgatgaaactacagcagacaaccggaaagtaaagagcaccataacattagagaatggctcaatgattcacgtccaaaaatggcttggcaaagagacaacaatcaaaagaaaaattgtggatgaaaaaatggtagtggaatgtaaaatgaataatattgtcagcaccagaatctacgaaaaggtgtga

SEQ ID NO: 388 - DNA, 2969 bp, Homo sapiens
  CDS (567)..(2711)
gagccagaggggttggaggagactgagcacctggggtgaggggagctgccgggcctttcagcccggtggtctccacgatgctcccatctgtgtggacgacaatcagtgtcgctttttcggtgttcaggctgtccccgatctgaagggccgtcctaccagacagaacatgtcctgagatggatgccgcgttcgccacagacgtggtgaagacattgtctgcagcagcccccacgttggccactgtcactgtggtcacctctgccccgtcctgcccactcccagctctggggcttggtgggggcaatccctgcgtccggagagcgctggtggtagggaggcttctcccggttctgtgagcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgctgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttctctactcgtgtatgtctttcggatccccgacccggcgggggtgtggtgctggtaaaagtcctgccctgttgggggccaacgccctcctttgcaacgtgccacggccgccccccagatttcccaaccgcgctgttggtcgccttgtccttcttggccgctctcggggcctttgcccgccggggcgcctcc

SEQ ID NO: 389 - DNA, 1637 bp, Homo sapiens
  CDS (151)..(441)
ttattttctacgagctgtgagctaactaacccgaggccgtttttaatacacgaggaactcatgcaaaggaggggactttcggaaatccaaacttagagtgccttgtatttagaatccggaaggaaaaggaaatgaaatgtgaagaaactcatgcaccaaactcgaactggtaagaagactgttagaatgccctcggtaacacagaggctgagagatcctgacataaatccttgtttgtcggaatctgatgcttccaccagatgtctggatgaaaataactatgacagggaaaggtgttccacttacttcttgaggtacaaaaactgccggagattctggaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatcccaggctcattcctcaaatcacttcttacttccctcacttatctttgtttaaataaggttagtacattcactaggggcaaatgggtttttctaaataaatgacataaaaaagaactggttgtctttctttaaagaaagtcttagttacaggattctgtgattaaaatccttaaatattgggttgccttctgcagctgtagtatcagtttttgaaccacagtaatgggaagaaagacaaatggattcccttagaagtaagatttctatttgcaggatgagttgggcagggaaaagggtcagggttcatcaggtgaactcaacactgggatgagactagaacttcactttatgatataaacacaatacgattattcaatgtggtgactggggtagactgtgaagcagccctccttatgcccactgccttttagaatcgtttgttttattcatggtagttttatgaagacatactattattgaatgaaatttaatgtgtacttgaaaacattgcttttgtcccttctcttcatctggtcttgggtcaagaacattgttttaatggctgccgacaatgaactgtctgtctgagtctaaaaccaagctcaggtttctaagccacatgaccttgattgttaaatgtagttatatttgaataaaaaatgaatcatttccaaaaaaaaaaaaa

SEQ ID NO: 390 - DNA, 4483 bp, Homo sapiens
  CDS (191)..(4000)
gctaaatgtcccaaggggattattacagaaatgttagaaagtactattgtttttatatttgagtgatgtgtttgaaaatcactttaaaatggctggaatgatcttccaagatctaacggtagggtaaggagattgcttttctcacctgatgaaacaaatacatacttttcatcttttgcagagttgaacaatgaccatagttgacaaagcttctgaatcttcagacccatcagcctatcagaatcagcctggcagctccgaggcagtctcacctggagacatggatgcaggttctgccagctggggtgctgtgtcttcattgaatgatgtgtcaaatcacacactttctttaggaccagtacctggtgctgtagtttattcgagttcatctgtacctgataaatcaaaaccatcaccacaaaaggatcaagccctaggtgatggcatcgctcctccacagaaagttcttttcccatctgagaagatttgtcttaagtggcaacaaactcatagagttggagctgggctccagaatttgggcaatacctgttttgccaatgcagcactgcagtgtttaacctacacaccacctcttgccaattacatgctatcacatgaacactccaaaacatgtcatgcagaaggcttttgtatgatgtgtacaatgcaagcacatattacccaggcactcagtaatcctggggacgttattaaaccaatgtttgtcatcaatgagatgcggcgtatagctaggcacttccgttttggaaaccaagaagatgcccatgaattccttcaatacactgttgatgctatgctgaaagcatgcttgaatggcagcaataaattagacagacacacccaggccaccactcttgtttgtcagatatttggaggatacctaagatctagagtcaaatgtttaaattgcaagggcgtttcagatacttttgatccatatcttgatataacattggagataaaggctgctcagagtgtcaacaaggcattggagcagtttgtgaagccggaacagcttgatggagaaaactcgtacaagtgcagcaagtgtaaaaagatggttccagcttcaaagaggttcactatccatagatcctctaatgttcttacactttctctgaaacgttttgcaaattttaccggtggaaaaattgctaaggatgtgaaataccctgagtatcttgatattcggccatatatgtctcaacccaacggagagccaattgtctacgtcttgtatgcagtgctggtccacactggttttaattgccatgctggccattacttctgctacataaaagctagcaatggcctctggtatcaaatgaatgactccattgtatctaccagtgatattagatcggtactcagccaacaagcctatgtgctcttttatatcaggtcccatgatgtgaaaaatggaggtgaacttactcatcccacccatagccccggccagtcctctccccgccccgtcatcagtcagcgggttgtcaccaacaaacaggctgcgccaggctttatcggaccacagcttccctctcacatgataaagaatccacctcacttaaatgggactggaccattgaaagacacgccaagcagttccatgtcgagtcctaacgggaattccagtgtcaacagggctagtcctgttaatgcttcagcttctgtccaaaactggtcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacgcatctacgatgtcagtttctagtaaagtaacaaaaccgatcccccgcagtgaatcctgctcccagcccgtgatgaatggcaaatccaagctgaactccagcgtgctggtgccctatggcgccgagtcctctgaggactctgacgaggagtcaaaggggctgggcaaggagaatgggattggtacgattgtgagctcccactctcccggccaagatgccgaagatgaggaggccactccgcacgagcttcaagaacccatgaccctaaacggtgctaatagtgcagacagcgacagtgacccgaaagaaaacggcctagcgcctgatggtgccagctgccaaggccagcctgccctgcactcagaaaatccctttgctaaggcaaacggtcttcctggaaagttgatgcctgctcctttgctgtctctcccagaagacaaaatcttagagaccttcaggcttagcaacaaactgaaaggctcgacggatgaaatgagtgcacctggagcagagaggggccctcccgaggaccgcgacgccgagcctcagcctggcagccccgccgccgaatccctggaggagccagatgcggccgccggcctcagcagcaccaagaaggctccgccgccccgcgatcccggcacccccgctaccaaagaaggcgcctgggaggccatggccgtcgcccccgaggagcctccgcccagcgccggcgaggacatcgtgggggacacagcaccccctgacctgtgtgatcccgggagcttaacaggcgatgcgagcccgttgtcccaggacgcaaaggggatgatcgcggagggcccgcgggactcggcgttggcggaagccccggaagggttgagtccggctccgcctgcgcggtcggaggagccctgcgagcagccactccttgttcaccccagcggggaccacgcccgggacgctcaggacccatcccagagcttgggcgcacccgaggccgcagagcggccgccagctcctgtgctggacatggccccggccggtcacccggaaggggacgctgagcctagccccggcgagagggtcgaggacgccgcggcgccgaaagccccaggcccttccccagcgaaggagaaaatcggcagcctcagaaaggtggaccgaggccactaccgcagccggagagagcgctcgtccagcggggagcccgccagagagagcaggagcaagactgagggccaccgtcaccggcggcgccgcacctgcccccgggagcgcgaccgccaggaccgccacgccccggagcaccaccccggccacggcgacaggctcagccctggcgagcgccgctctctgggcaggtgcagtcaccaccactcccgacaccggagcggggtggagctggactgggtcagacaccactacaccgagggcgagcgtggctggggccgggagaagttctaccccgacaggccgcgctgggacaggtgccggtactaccatgacaggtacgccctgtacgctgcccgggactggaagcccttccacggcggccgcgagcacgagcgggccgggctgcacgagcggccgcacaaggaccacaaccggggccgtaggggctgcgagccggcccgggagagggagcggcaccgccccagcagcccccgcgcaggcgcgccccacgccctcgccccgcaccccgaccgcttctcccacgacagaactgcacttgtagccggagacaactgtaacctctctgatcggtttcacgaacacgaaaatggaaagtcccggaaacggagacacgacagtgtggagaacagtgacagtcatgttgaaaagaaagcccggaggagcgaacagaaggatcctctagaagagcctaaagcaaagaagcacaaaaaatcaaagaagaaaaagaaatccaaagacaaacaccgagaccgcgactccaggcatcagcaggactcagacctctcagcagcgtgctctgacgctgacctccacagacacaaaaaaaaaaaaaaaaaaaaaaattggcggccgcatcattggtccttttccaccattttcagcccctccaggctgtggaggacccggcggccacactcttggagcctcggctgaagtgcctgggcatgacgccgtttctctgacgtcccccatagatcttggtcatggagccaactccagcgccaccccggaggtacaggtgccgcgctgtggaagcaggctcgctggtagaagcagttctcatccgtaggagcaagctctttgtgcttggccagcttgacggtatccaaccattcggggactttcagcttcccggactttatgaaggaaggctggcagaagcgctgacgaactgctggttggttgcacgttcttttaagttaacttccaggcaccgttgtggcctccgcactggccagcaagcctcgttccgcgattctttggtctcgtagggcaaatttccttatagtgaggtcgtgttgaaactccgtatcacggtcctggttgtttgctcgtgttgaatgtgtgtgcgtctacccgtgtccccgagataagcgagtctgagaggttaatgtgtatggccttgggtgctca

SEQ ID NO: 391 - DNA, 1643 bp, Homo sapiens
  CDS (241)..(1245)
ctggggatgattttgggatgccttgaaaaaatgtcatgaagtagaaaggcactctccttccacatggaccacaggaggaaaagagccgcaaatgcacccctgaggcagtcctcagcagccctcagttgtgggggcaatcggcaccactgttcccatcctgacgcagtatagaaccacaggcatcgtagtcagcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgagcttttgccattaacagtaataacccatggttacatgaatgtttaattagattttctaaatctgtgtctaatcatagtaatcttccagacattgtgagcaaagttctatctcaagaaatgcagaaaatatttgtcaaaaaggatttggaaagttttaatgaggattttctgaaacgtaacgctacctctcttcagcatctactttcaggtgctaaaatgatgtattttctggacaagtcaaggcaggagaaagcaattgctatagccactagactagatgaaactataaaagataaagatgtaaagacattaataaaggtttctgaagcactgcttgatggcagctttgggaactgtagttcccaatatgaagaatataggatggcctgtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccaggttgcattttaatatacgtatgaaatgaaatatttggttaggatttttaaatggcatattctgtaagcttattttgttctttacccgacctgccaatttacataaccatctgttaaaattacctgtttattcttacacagttttgtggtagctccgatcgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgtta

SEQ ID NO: 392 - DNA, 2416 bp, Homo sapiens
  CDS (314)..(1546)
ctatgtctgctggtgttaatcggccgaggcgcagatggcggcgcccagaggctgctgaggcgcggaacggagtgatggctgctggtggcgttggtggctgggtgctcgtgctgggtgcggcggctgagctgtgtgccggtggctggtggctgaggtgcactggacctggctggccagtgcgctcccgtgagccgtgcgcgaagctgtgcagaagcctgagtgctggagtgtgccctgtgtgtaccagtactgtgtgtgctgaagctgctgcttgccctgctgcctgatcgcgtcttcagtgtgtgtgtgcttcatgcattctctgtgtgtgtgcgcttggtgctgttgcctatcctattgttggttgcccatgcttcctgtgtgccctgtgtgcccctgctgcctgtgcgccctgacctgctgcctgcagttgatccatgccctgtgccctatcgcctggatgcttggaccaaaagattatcatcttgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggttttaagctctgaaaaaaaaaaaaa

SEQ ID NO: 393 - DNA, 743 bp, Homo sapiens
  CDS (202)..(639)
ctgtcgtcctgaccactcccaccgctgtgaaggtagagggaatcccagcctggatccaccacagccgtgtaaaacctgcagcacctgaaacctgggaggcaagaccaagcccagacgacccttgcagagtgaccctgaggaaaacgacaagccctgctccagtcacacccagaagctgactggtccacccacggccgaagcatgaggaagctcatcgcgggattcatttttcttaaattctggacttacacagtaagggcttcaactgaccttactcaaactggggactgttcccagtgtattcaacaggtcactgaagtaggacagcaaattaaagcaatctttctgttctatagttattatgaatgtatggaaacaataaaagaaacttgtttgtataatgccactcagtacaaggtatgtagcccgagaaatgaccgacctgatgtgtgttataacccatctgagccccctgcaaccaccgtttttgaaataagaactggccttttgctaggtgatacaagtaaaataataactagaacagaagaaaaagaaatccccaagcaaataactttaagatttgatgcttgtgcagccattaatagtaaaaagctagaaataggatggggatctcttaactgagaaaggagcttaagagtagaaaataaatttgtttgtcatgagtcatgggtttgtaaaaattgtgcctatcggccatgcgttatttaggctacttaaaaaaa

SEQ ID NO: 394 - DNA, 4631 bp, Homo sapiens
  CDS (641)..(2515)
cccccaacccctttcttctcttcaaccagtagcctccaccttcccatccctgctttggagaaggaggaaaacgcagcttgagatctactcgaagaactgaccctcagctctcacaggctgccgccgagctgcaagcatgccgccgctccactcaggtaaacttcggagtgagttacctgcacttggagaagggccttacctgagcgcgcctctgccaatggcagctcacctgagggagctccccagccaatcatcgcgcagctcgtccctcgggcttgtaccctttagtgaaagaattcagctccttgcgagaaagttacctgtggccgcccaagtccgccactttctgctctgtgtctgcccattgccacgatccaggaggactccgcgccgcccggccgcctccgagctcgggccccatgtgaggggcccccccttatcccacctttccggctaggtgagggcgcgagcgggcgagcgagcgagagtggtgaggggggacggaaaagcagaattacctgtagctcttgttctgccatctcgggcgctctcacacaccttcacctgcacagacttgaaagtccagtttcaccagaggctgaggctccaggaaaaggggagcaagctcattggatcaaacatgtcacaagagtcggacaataataaaagactagtggccttagtgcccatgcccagtgaccctccattcaatacccgaagagcctacaccagtgaggatgaagcctggaagtcatacttggagaatcccctgacagcagccaccaaggccatgatgagcattaatggtgatgaggacagtgctgctgccctcggcctgctctatgactactacaaggttcctcgagacaagaggctgctgtctgtaagcaaagcaagtgacagccaagaagaccaggagaaaagaaactgccttggcaccagtgaagcccagagtaatttgagtggaggagaaaaccgagtgcaagtcctaaagactgttccagtgaacctttccctaaatcaagatcacctggagaattccaagcgggaacagtacagcatcagcttccccgagagctctgccatcatcccggtgtcgggaatcacggtggtgaaagctgaagatttcacaccagttttcatggccccacctgtgcactatccccggggagatggggaagagcaacgagtggttatctttgaacagactcagtatgacgtgccctcgctggccacccacagcgcctatctcaaagacgaccagcgcagcactccggacagcacatacagcgagagcttcaaggacgcagccacagagaaatttcggagtgcttcagttggggctgaggagtacatgtatgatcagacatcaagtggcacatttcagtacaccctggaagccaccaaatctctccgtcagaagcagggggagggccccatgacctacctcaacaaaggacagttctatgccataacactcagcgagaccggagacaacaaatgcttccgacaccccatcagcaaagtcaggagtgtggtgatggtggtcttcagtgaagacaaaaacagagatgaacagctcaaatactggaaatactggcactctcggcagcatacggcgaagcagagggtccttgacattgccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctagccctgggtttggcatccgctttggctggagctctcagtgcgttcctccctgagagagacagaagccccagccccagaacctggagacccatctcccccatctcacaactgctgttacaagaccgtgctggggagtggggcaagggacaggccccactgtcggtgtgcttggcccatccactggcacctaccacggagccgaagcctgagcccctcaggaaggtgccttaggcctgttggattcctatttattgcccaccttttcctggagcccaggtccaggcccgccaggactctgcaggtcactgctagctccagatgagaccgtccagcgttcccccttcaagagaaacactcatcccgaacagcctaaaaaattcccatcccttctttctcacccctccatatctatatctcccgagtggctggacaaaatgagctacgtctgggtgcagtagttataggtggggcaagaggtggatgcccactttctggtcagacacctttaggttgctctggggaaggctgtcttgctaaatacctccagggttcccagcaagtggccaccaggccttgtacaggaagacattcagtcaccgtgtaattagtaacacagaaagtctgcctgtctgcattgtacatagtgtttataatattgtaataatatattttacctgtggtatgtgggcatgtttactgccactggcctagaggagacacagacctggagaccgttttaatgggggtttttgcctctgtgcctgttcaagagacttgcagggctaggtagagggcctttgggatgttaaggtgactgcagctgatgccaagatggactctgcaatgggcatacctgggggctcgttccctgtccccagaggaagccccctctccttctccatgggcatgactctccttcgaggccaccacgtttatctcacaatgatgtgttttgcctgactttccctttgcgctgtctcgtgggaaaggtcattctgtctgagaccccagctccttctccagctttggctgcgggcatggcctgagctttctggagagcctctgcagggggtttgccatcagggccctgtggctgggtctgctgcagagctccttggctatcaggagaatcctggacactgtactgtgcctcccagtttacaaacacgcccttcatctcaagtggccctttaaaaggcctgccgccatgtgagagctgtgaacagctcagctctgagtcggcaggctggggcttcctcctgggccaccagatggaaagggggtattgtttgcctcactcctggatgctgcgttttaaggaagtgagtgagaaagaatgtgccaagatacctggctcctgtgaaaccagcctcaggagggaaactgggagagagaagctgtggtctcctgctacatgccctgggagctggaagagaaaaacactcccctaaacaatcgcaaaatgatgaaccatcatgggccactgttctctttgaggggacaggtttaggggtttgcgttcgcccttgtgggctgaagcactagctttttggtagctagacacatcctgcacccaaaggttctctacaaaggcccagatttgtttgtaaagcactttgactcttacctggaggcccgctctctaagggcttcctgcgctcccacctcatctgtccctgagatgcagagcaggatggagggtctgcttctagctcagctgtttctccttgaggttgcggaggaattgaattgaatgggacagagggcaggtgctgtggccaagaagatctccgagcagcagtgacggggcaccttgctgtgtgtcctctgggcatgttaacccttctgtggggccaaaggtttgcatcgtggatccagctgtgctccagtctgtcccctcctcctccactctgactgccacgccccggaccagcagcttggggaccctccagggtactaatggggctctgttctgagatggacaaattcagtgttggaaatacatgttgtactatgcacttcccatgctcctagggttaggaatagtttcaaacatgattggcagacataacaacggcaaatactcggactggggcataggactccagagtagg

SEQ ID NO: 395 - DNA, 1079 bp, Homo sapiens
  CDS (361)..(816)
tgtcgttgttctgagctatgtcttcaaccacctggcggcccagcatgattcctggactattgtaggggttgctgccctcatcctgttcctggtagcactgctggctcgtgtcctcgtcaaaagaaaaccaccccgggacccactgttctatgggtgaaccgtatctgaacaccgcatatgggcacatgatctgctactgggatggctctgctcattatctgatgtacctggtgatggtggcagccatagcatgggagtaagtcagttcacctggtgtgtgcctttgccaccttagcaaccgataagcgggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaaaaaaaaaa

SEQ ID NO: 396 - DNA, 967 bp, Homo sapiens
  CDS (152)..(409)
cccacgcgtccggaagaatcgggctagagcggcgaagctcgtatccaaggccagcgctgaggacgcagcatccgggtttcttcctggtaccgtccccaccagatgtccttcggccttctccgtgtgttctccattgtgatcccctttctctatgtcgggacactcattagcaagaactttgctgctctacttgaggaacatgacatttttgttccagaggatgatgatgatgatgactaacaggaattacagaaaggagaaagcactaactgaagaaatggtgatgctctcagtttctctgccttccctatcagcagaaaggctcggggaaggccctcagcctcccagtctggtgaagcttcctgtatggtccatgaccgtattccaccccaggctctgggaggctccctgagatgtgctgtccactaagcactgcacaaacaagcaatcaaattatgaataaacataataaatatcagccgtgcgtgactgagtgatggctgcagtttctcagtatccctaggttctagttggtgcagttgtctctgctgtcctttatttatgggagaaacataggcccaggctatccaggctgcagtggagcctggtgaactattctgggggccctgggaactattttcattgtttacaaaagcccaacagaaactgtgcattttcccttaagaaagcttcatgggctaactaaagcctcatgccattctgtgttcagtgccagtcatgacagctctgcttgttagcatactacttaaatataactagaatgattcaaaactcgggttctgtgatatgaggatatagataggttttcatctatttcctggcttataactcccaaaacccttgctttaggcttttgttataatgttgggcacttcgggcctcagaaaacagcaggctgtttctcagatcttctcctgacctcctttcacctgctggcttttctccc

SEQ ID NO: 397 - DNA, 1923 bp, Homo sapiens
  CDS (113)..(1372)
cctgagctctgtaacctgccctttctagatcactctctatgaaggcaagcacttcacagggcagaagctggaggtcttcggggactgtgacaacttccaggaccggggctttatgaaccgagtgaactccatccacgtggagagcggagcctgggtctgcttcaatcaccccgacttccggggccagcagttcatcttggagcacggcgactaccccgacttcttccgctggaacagccacagtgaccacatgggctcctgtcggcctgtaggaatgcacggagaacatttccgcctagaaatcttcgagggttgcaacttcacgggccagtgcctggagttcctggaggacagccccttcctccagagcaggggctgggtcaagaactgtgtgaacaccatcaaggtgtacggggacggagcgtgggtcctgtatgaggagcccaactaccacggccgcatgtacgtggtggagagtggcgacttccgcagcttctcggactgggaggcccacagcgcacgagtgcagtcgctccacaagatctgggggcaatttcccagaggagagtctgtaatctacgacctgcaagagaaaagggaagacaggctggctgaggacatctgcacccacagctctacagtccagactcaacccccagagatggctggctcatccccaccagggggccactttgtgccaaaccggagaaggaggggtgggggaggtggagaagccaagaacaaaaaatctatcaacctggaaagaggaagtaggagtcgggctccccgttccccgcgatggccgcgggccgcagtcgtacggagccgccgcgcggaccccggggcgcccctccctagcggggcgcagctccttcttgttccccgccctgccagcgggatggggggcggcgggtcggccctgagggtctgcgccgaccaccgcgggggcatcaactggctgagcctgagccccgacgggcagcgcctgctgacgggcagcgaggacggcacggcccggctctggagcaccgcggacggccagtgctgcgcgctcctggaagctcaccggccccagaccgcggaccccagctcctgcgcccgcagacccctttctagaagtccagcccccgctcatcccggcacactagcggaagagcgcttgtctgggcccagcatctggctgttgagcgcacggcagggcagggtgccttgtggcctctttgtggccaattgtgctcttctgctggcatttcctgttgacgactctcacagcaacagtagacgcttgttaagggccagcggtgcggagaagtgtgccgtcgtcacactatgttaccccacatacagacgtggaaacaggctgggagttaagtaattcgcccaggtcgcacagccagtgaggggtagatggcagtctgagccctctcattgctgtaaaccctgcctgcatgcctgttggtttctatttgtgccctgtactcactcaggaggtcagtgtgcctcgggtgcaccttcccctgggcctgtcccatgcactgtgaggtccctttcagctctggccctcctactgcccaggtagcacacgtagtcccctggatgagccgcgaggctttctgctgtgggtagttctttatcaccgcgggcttttccaccatcatcagtgaactctctgtggcctcgcccaggccttccaacttaggaattttcaaggacggggacagaggtcatctttctttatcctgagattctactgatacgctcaacttgcaaaagagtcattgtgagtgtgtgacagtccttttgtgtggatccccaaagaaagcaaggtgttgccagttcctttctcctgcaggattttttttttctatcagtgaaatattattaaaatgtcttaacatttgtttagtgccctaaaaaaaaaaa

SEQ ID NO: 398 - DNA, 307 bp, Homo sapiens
  CDS (18)..(149)
ttgtctctgatatttatatgccattatgtggcctctactgccttaggattctaatgttcccactaagatcagctaactcagttccactacagggtttaccaccatcatctctcgcaaacaaagacagccacttcagagctcctaggaaatagtggtgctcccatcatcattgcattccttaatgacatggtgaaaattaacaatggctaaggagcctttgtgttttctcctctacaatatgcccaggaatttctggcattttggccatcttatttataggctattactgaatttaagcctcatccta

SEQ ID NO: 399 - DNA, 1545 bp, Homo sapiens
  CDS (952)..(1134)
  misc_feature (1)...(1545): n = a,t,c or g
acagcaagatatgcagggcccctaacttcaaatagatgtagattttaaatgagcctctgtagtccattttatccacagaagttgcagatgcctatcttcctgttgtataacgtatcaggtcagggaatataatttgtaccaggtatgtcattntgctgttcagagagtcattaggttcctcccagaatatatgtgattgatatccctgnaggtaaaggctaaaggaaccatatggcacatgtntgcattccgtatgctatctgcccatccgtgcttaagctgtcattagcaacatctgtaccttacggaaatccagctgcgccgacgacggctgacggaattgtacttggggggaaaatctagcttagcgccattaacttgagacttagagtctatctaccaggacggatggaagctttcacaattagacgagacgacacgaatgctttattaaagtttaattttgaactcccaattagcgaaagtgcattacaaatcgattgcaatttcctagaaggtgcagcaagttctctgcctgcctgccacgtgcgagacgctccacagcgagcttccccagctccgggcagcagaaaggggatggttcagagccgatctccgcatcccaggaagtccctaaaatccgcgccagcccctcctcccgcagggcgggggcgtccacggcgcgaacccgccagaggtgtagggggaagtgtggggggctggtccgcagccttcgaggggtggggcgacaggagcgagcggccgggggaggagaaaaaggcgggcggcgggagagggggcctctattatctcggcttctcgggaggagcctcatctagtcagtcacgcagaagtttctctttcgctcttcgcgctacacacccagattggcttccagcgcgcaggtaaaacctggctgtgccctgttgaaatcaattctgttgcagtcatatgcggtggaatctgttcttcttttgcatcctacgtaaccagaccaagctgtgggcttctcaaggtagcctccaggatgcacagagtgagagaggatgcttttccctaaaccaggaacaaagtccagccctaaggagattggaccactcccgaccaatgagtttggccagggaggtcatgcactgattggctcagccctggatcagtctacttctcaaccaatcaaggtgctaaggaaataggattaccctaaacgatttaacacaccgggactcattcctgaagctggagatgctgtaacacaatcaaaactgtaaggcttaaaagaattaaagtaggaattgccgcaattcccttcctagacttattcccaaatatacttactatggactacctgcatacagcagccccttcacatatttttactgcctgtcataaagtagtctgggttacatttaaagaagctgccagcacttaatgcatagaagtactaaaaatttgttactgatgtttgaaaaatatagaaaattaaaagcggaatggctgagtgtagtggcttacacctgcagtccctacatgttaagaggccaaggg

SEQ ID NO: 400 - DNA, 2114 bp, Homo sapiens
  CDS (188)..(1630)
tttcgtggacgggagggcacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagaccacttggagccagtgactatttggaactatcaaagaattttgatacaatatttttacgaaacattccgcaatttactctggcaaacaggactcaaggtcgaagattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaacccgatataaactaaaagggataatattttagaaaaaaaaaaaa

SEQ ID NO: 401 - DNA, 1973 bp, Homo sapiens
  CDS (188)..(1489)
tttcgtggacgggagggcacgggagtgcagcccgcccatgtggctactggaggtcacgttccctaactgatcccttggttctctcgggtggagccttcagcgtgcacggcggggtttgactttgccaccgtctctcttctgggttccaataaagttttcctcttcctctcctcgtacggagttcaagatggcggcctcctggtcgctcttggttaccctgcgccccttagcacagagcccgctgagagggagatgtgttgggtgcggggcctgggccgccgctctcgctcctctggccaccgcccctgggaagcccttttggaaagcctatacggttcagacatccgagagcatgaccccaactgccacttcagagacttatttgaaagctttggccgtttgccatggacctctggaccactatgattttctgatcaaagctcatgagctaaaggatgatgaacatcaaagaagagtcatacagtgtttgcagaaattacacgaggaccttaaaggatacaatatagaggcagaaggccttttttcaaagcttttttcaaggagcaaacctccaaggggcctgtatgtttatggagatgttggtacaggaaaaacaatggtgatggacatgttttatgcttatgtggaaatgaagaggaaaaaacgggttcattttcatggtttcatgctagatgtgcacaaaagaatacatcgccttaaacagagtttgccaaaaaggaaaccaggattcatggctaaatcatatgacccaatagctcccatagccgaagaaatcagcgaagaagcatgtctcctatgttttgatgaatttcaggtcactgacattgctgatgccatgattctgaaacagctttttgaaaatctgttcaaaaacggggtcgtcgttgtggcaacatccaacaggccaccggaagatctctataaaaatggactccaaagagctaactttgtaccattcatagcagtcttgaaggaatattgtaatacagtccagctagattctgggatagattaccggaaaagggaacttcctgctgcaggaaaactctactacctcacaagtgaagctgatgtggaggctgtcatggataagttgtttgatgagctggctcagaaacaaaatgatttaactagaccaaggattctaaaagtgcaaggcagagagctgcgcctgaataaagcctgtggaaccgttgccgactgcacatttgaagagctgtgtgagagagtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagaggaaatctttgcatttcagcgcacaatttcccgactcacggaaatgcagactgaacagtactggaatgaaggagacagaaccaagaagtaactgccacttttgcataaataaaactctagacaaatggttaacgcaggcagaactccttattgtgggacttgaaggaatcattttctcatcattaattatgcactttgtcctctggaccattttaatctaaaattgctctcaaggatctagtggattagtaagttaaacacttaacattttttaggtctgctttttcttatttggccttatttctgcaccatgaaattaaaatcatctcattcctgaagatgaatgtaggaccagacattttagcttcacattaaaccacctgaatgaaccttgaatgcacaagtaaatgcaagacgtctggataccttcaagctttggctgcatggtggtggcatgttagaaatacatcttttataatgggggaagaatgccctatgtttcaattcaaaacaaagacagttttccaacccgatataaactaaaagggataatattttagaaaaaaaaaaaa

SEQ ID NO: 402 - DNA, 1504 bp, Homo sapiens
  CDS (44)..(931)
gcgagactgcgtctcaaggaacaacaacaacagcaaaaaagaaatgggacagaaagttgtaaggccagatgtgggtgactcaccgactcgcagcgatgtcgaggtcccccgaatccactgggacctgtccacggagcgggtcctcctgatggagtttgtggatggcgggcaggtcaatgacagagactacatggagaggaacaagatcgacgtcaatgagatctcacgccacctgggcaagatgtatagtgagatgatcttcgtcaatggcttcgtgcactgcgatccccaccccggcaatgtactggtgcggaagcaccccggcacgggaaaggcggagattgtcctgttggaccatgggctttaccagatgctcacggaagaattccgcctgaattactgccacctctggcagtctctgatctggactgacatgaagagagtgaaggagtacagccagcgactgggagccggggatctctaccccttgtttgcctgcatgctgacggcgcgatcgtgggactcggtcaacagaggcatcagccaagctcccgtcactgccactgaggacttagagattcgcaacaacgcggccaactacctcccccagatcagccatctcctcaaccacgtgccgcgccagatgctgctcatcttgaagaccaacgacctgctgcgtggcattgaggccgccctgggcacccgcgccagcgccagctcctttctcaacatgtcacgttgctgcatcagagcgctagctgagcacaagaagaagaatacctgttcattcttcagaaggacccagatctctttcagcgaggccttcaacttatggcagatcaacctccatgagctcatcctgcgtgtgaaggggttgaagctggctgaccgggtcttggccctaatatgctggctgttccctgctccactctgagtggaattgctctccctgccccattctggtgtctttccactcctcagcccctcatcttgcctccacccagctgctccatttttgccacatcgtggcccgcagccccagagtcactgtccatgtcaccatcctcctcctcctttggaatcctctccgcacactgtggcccttgtctcagggcccacaagctgaactgtggcatagctctctcttcttctccaagaagactcagcagcctacattcccattcctggtatgtgccattgggttggatgtccccactacttccgttaacccttcccattgtcaagatgtgccacgggtgccactgggggcacactgaacttgtagggagtgtgattttgttggaggtgcacatggtctctgaatttgacagagaacaccttccctttccttgccatgtcaccctccagaggaagtcacacctcagcgaggtggtttggcatctggggccaactccattacagctatgagctcactgctgtcagtgacgtttggtgttttctgtactgtgtttcaataaaaactccttcaaggttaaaaaaaaaa

SEQ ID NO: 403 - DNA, 1300 bp, Homo sapiens
  CDS (188)..(913)
cgttggtccacatcctagcagttctcttggtgttcctgcgtgatcaaaggatggctgccacaccccagcctgctgacctcagccctggcgtgggcataggagggtctgcgtggctgagcatccagtgtccttcgtactgccactgacagcctcaggcctgatttccagcactgtctgtccaggagcaatgggagcaagagtcactccacaagactctggaggcctgataggtatcgagaaccttccctgcgaacttcagaggaacttccagctgatgcgagagctggaccagaggacggaagataagaaagcagagattgacatcctggctgcagagtacatctccacggtgaagacgctgtctccagaccagcgcgtggagcgcctgcagaagatccagaacgcctacagcaagtgcaaggaatacagtgacgacaaagtgcagctggccatgcagacctacgagatggtggataaacacattcgaaggcttgatgcagacctggcgcgctttgaagcagatctgaaggacaagatggagggcagtgattttgaaagctccggagggcgagggttaaaaaaaggccggggtcagaaagaaaaaagagggtcccggggccgaggcaggaggacatcagaggaagacacaccaaagaaaaagaagcacaaaggagggtctgagttcactgacaccatcctgtccgtgcacccctctgatgtgctggacatgcccgtggacccaaacgaacccacgtactgcctgtgccaccaggtctcctatggggagatgattggctgtgacaatccagactgtccaattgagtggtttcactttgcctgcgtggaccttaccacgaaacccaaaggaaaatggttctgtccacggtgtgtccaggaaaagaggaagaagaagtaggaggagctgtgtgcccggatccgaggagcaagttaatctgtcccttcattcgtgtcgcaatatttcccttccttttaaaactaccttgttcggttgatacttagtaactccgtggccagttgaagcgctggatgtttcctagaacaagaaccaccaaagcctgttcgcacagaagggcgaccttgcagggactcgccgccgcgacctcagtgtggcttttacaggactccccccgagcatcagcagggaccccggcggacgtgggcgggcgcgcgtgagctcgggctgcccggccgggcgtgcgggcggggacatggtaacctggtccacggagggcggccgccaccctcgcgtagctttcctgtggttttccaggactgtccg

SEQ ID NO: 404 - DNA, 933 bp, Homo sapiens
  CDS (155)..(694)
ttcggcacgaggcggtttcctgcttcaacagtgcttgaacggaacccggtgctcgacccctccgacccccgccggccgcttcgagcctgagccctttgcaacttcgtcgttccgccgctccagcgtcgccaccgcgcctcgccccgccgccaccatgaccaccgcgtctccctcgcaagtgcgccagaactaccaccaggacgcggaggctgccatcaaccgccagatcaacctggagttgtatgcctcctacgtctatctgtctatgtcttgttattttgaccgagatgatgtggctctgaagaactttgccaaatactttctccaccaatctcatgaggagagggagcatgccgagaaactgatgaagctgcagaaccagcgaggtggccgaatcttcctgcaggatataaagaaaccagaccgtgatgactgggagagcgggctgaatgcaatggagtgtgcactgcacttggaaaagagtgtgaatcagtcactactggaactgcacaaactggctactgacaagaatgatccccacttatgtgacttcattgagacgtattatctgagtgaacaggtgaaatccattaaagaactgggtgaccacgtgaccaacttacgcaagatgggtgcccctgaagctggcatggcagaatatctctttgacaagcacaccctgggacacgggggatgagagctaagctgacttccccaaagccacgtgactttactggtcactgaggcagtgcatgcatgtcaggctgccttcatcttttctataagttgcaccaaaacatctgcttaggtctttaatttgacccatttcttccaattaaaaaatttgggtcccccgaaaacagggctgtgattggtgggaggtggtttctttaacaggcgggtttgtaccggaaggccctgtagtgttacgtc

SEQ ID NO: 405 - DNA, 2069 bp, Homo sapiens
  CDS (225)..(1856)
aaggatccttaatttattaatccccccccccccccccccggccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcgggacagctgcaggcatggccctgcgctatgagggtgagcctgctggggcctcactgggggtggcgggtccacggggatgggctcgggcctagggtctttctcccacaccctacccctctctgcctccatgctgtcactccttccaagtcagcccctgctcactcagtacttaggccccctttccctgcccctctctttgggtccgggatccctaccacagctttgcaggaaacctctgcctggacccaggccctatggtccaagggaataaattctccagattttgaaaaacaaaaaaaaaa

SEQ ID NO: 406 - DNA, 741 bp, Homo sapiens
  CDS (440)..(685)
atgagggggggatgggggggggggttttttggcgaaagagaaataaagatttttttggggggggggggaagcggggaggggtctcttggggggtttttttaagtaaagaagggggaaaaataaaaagggggttttaccggttttgtgccgggcctcccccaaatgggaactttttttaaattttaagggttttgagtttttggggaaccctcccctggggtacatcctcccctgcccattcaacctgggccccgggtttggggcaggtgtgcatatcaaagtgcccaacctgggcaaacattaaaaatttttggaggtgtttaaacgggttgggctttaaaaaggaggcccaggcggtgtggacccggcttcggtggggggggtttttaacgtttccaacgttggccccctggggttttcaaaggtggaattggtgcaaatggtggtggacggaattaaacttttccttcaaaaggaacaacgggtggaacagggccaggccatttacgaccttatggctgcccaaaaaaaaaagccgggccccccccgaccccagccctggtgttttttaaattattgcctgggcagggccccccatgccccccttatttttcccgtttggggagcccttaacccttgtgtaaaaacttccgtcccccctgggaaaggttttttttttgaagggtaaaaaactgctgatggtgaaataaaatagggttttggccccccaaaaaaaaaaaa

SEQ ID NO: 407 - DNA, 3480 bp, Homo sapiens
  CDS (712)..(2301)
ccggaattttcgggtcgacgatttcgtgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgccgtgtttcccccggctatgccgccaccggccacccagcttgtcaccggcccctggggcccggtgcccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggtcacgctgcacaccgggctcccagtccccgacttctactccagcagagcatcaatagcctaaggatgtgccgtggaggcgccagctgcctgttcttacctccgcctgcgagagccacagcaaggagctcagccagccgtggtggggtgcagagttggcaggagtgggagaaggaggagagaaaagctggtcctctgcagtctttacacccacagctctgcccttttccctttcaacctctcctccgctgtcatgcctgcttccgcttccatgtccaacaattctaaccaacaaaggacctagacagcccaccaagtcacttggttcccactcccagattttgcttttatttaacttaattttttatgtaggtgagttatattttctttcttttctgatcaggttattggtgacttactggactggcaccgccaggagaaaattctcctgctaactttttttcttaagctttctgtcaaacaatgaggttgtagggggaggtagggaagaatgagctgaatttgtagcatacagcttacctgctagaatgttcttaccctcttacctctcctgtagcgttagctctgcagagctaagctttgggagaatgaatctatcactgagaagttttactactcattgaagcacaaaaatatccgctacacaggttcacatcagggtaggatcgttaggatggctctataattaggacaggccagaaccctggccactgtataaaattggaaagtctctaagacacaggcaaaccaggggacttaatgatttggttcgtttatttaataaaagcttttaattgagaacctactattgaccaggcactgttcaagacactagaacattatgttctagacactgtggggacacagtggtgaacagacaggcatggtctctgcccttcggagcttatattccagtaggagaaaaagcaaaaataaaataattataaatggtcatatgtactagaaaggaaatgggcaagggtcaaagagactcatgggcaagatctttcaggcttcctagaatgatgctaaaaatccacacattctggccatagcaccagaaatgtaccaactcaatgccttttcagctgcactatttaattatggtacctgctgccactcatcacagagcccttcttggtagaaatgatgtcagcattcttatttgctgatgctgctatgataccacgccttaaaaattgacagttgaaaaaaaaaa

SEQ ID NO: 408 - DNA, 687 bp, Homo sapiens
  CDS (22)..(489)
aagcttgcggccgccgccgcgatgtttccccgcgagaagacgtggaacatctcgttcgcgggctgcggcttcctcggcgtctactacgtcggcgtggcctcctgcctccgcgagcacgcgcccttcctggtggccaacgccacgcacatctacggcgcctcggccggggcgctcacggccacggcgctggtcaccggggtctgcctgggtgagcggggccgggggcggcaggcggggggctggcgggaaggccgtgcggggccgggggatggtctccgtgagcggaggggccccgcggcgagtcggtgggtaccgtggggagggttccggtccgcgcctggggaacccggcgaggatccaatccgggtcgctggcctgggggcggggcctggtttgttttgctccgagggtgcccggggcccgcctgtcgggcgcaaaggtttgggggcgggcaggtgcagcaaaagctgcttaattggacagaaaaagtaactcgtgggcgggaccgtgagaatccgaggagggacctaagtcaccccgtggccctggatattacaaccggtgccagcggtcggtcacagtgtcctgggcttccgcagttgcaggctgctatcagggggcctgggcatggggtagccccttgagaggcgtctgggaaccgtgacctggtcctttccaaaggccccg

SEQ ID NO: 409 - DNA, 1891 bp, Homo sapiens
  CDS (20)..(1621)
tttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttctaaaggagcaattctccaatacttacagtaatctcatattaacagagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttttgtggtcaagaatgtcaatgctttggcctgccgctaccgataagctatcctcacactcatggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcaaaaaaaaaaaaa

SEQ ID NO: 410 - DNA, 1967 bp, Homo sapiens
  CDS (25)..(1659)
atcttctcccgcgcacacacggccatggcggaggcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttggg

SEQ ID NO: 411 - DNA, 3571 bp, Homo sapiens
  CDS (260)..(3568)
ggaattcccgggtcgacgatttcgtaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtgggggctgccggcagccggggctggggagagacatgtggacacgtggcctctatggctcccgcctgccagatcctccgctgggccctcgccctggggctgggcctcatgttcgaggtcacgcacgccttccggtctcaagatgagttcctgtccagtctggagagctatgagatcgccttccccacccgcgtggaccacaacggggcactgctggccttctcgccacctcctccccggaggcagcgccgcggcacgggggccacagccgagtcccgcctcttctacaaagtagcctcggccagcacccacttcctgctgaacctgacccgcagctcccgtctactggcagggcacgtctccgtggagtactggacacgggagggcctggcctggcagagggcggcccggccccactgcctctacgctggtcacctgcagggccaggccagcagctcccatgtggccatcagcacctgtggaggcctgcacggcctgatcgtggcagacgaggaagagtacctgattgagcccctgcacggtgggcccaagggttctcggagcccggaggaaagtggaccacatgtggtgtacaagcgttcctctctgcgtcacccccacctggacacagcctgtggagtgagagatgagaaaccgtggaaagggcggccatggtggctgcggaccttgaagccaccgcctgccagacccctggggaatgaaacagagcgtggccagccaggcctgaagcgatcggtcagccgagagcgctacgtggagaccctggtggtggctgacaagatgatggtggcctatcacgggcgccgggatgtggagcagtatgtcctggccatcatgaacattgttgccaaacttttccaggactcgagtctgggaagcaccgttaacatcctcgtaactcgcctcatcctgctcacggaggaccagcccactctggagatcacccaccatgccgggaagtccctagacagcttctgtaagtggcagaaatccatcgtgaaccacagcggccatggcaatgccattccagagaacggtgtggctaaccatgacacagcagtgctcatcacacgctatgacatctgcatctacaagaacaaaccctgcggcacactaggcctggccccggtgggcggaatgtgtgagcgcgagagaagctgcagcgtcaatgaggacattggcctgccacaagcgttcaccattgcccacgagatcgggcacacattcggcatgaaccatgacggcgtgggaaacagctgtggggcccgtggtcaggacccagccaagctcatggctgcccacattaccatgaagaccaacccattcgtgtggtcatcctgcaaccgtgactacatcaccagctttctagactcgggcctggggctctgcctgaacaaccggccccccagacaggactttgtgtacccgacagtggcaccgggccaagcctacgatgcagatgagcaatgccgctttcagcatggagtcaaatcgcgtcagtgtaaatacggggaggtctgcagcgagctgtggtgtctgagcaagagcaaccggtgcatcaccaacagcatcccggccgccgagggcacgctgtgccagacgcacaccatcgacaaggggtggtgctacaaacgggtctgtgtcccctttgggtcgcgcccagagggtgtggacggagcctgggggccgtggactccatggggcgactgcagccggacctgtggcggcggcgtgtcctcttctagtcgtcactgcgacagccccaggccaaccatcgggggcaagtactgtctgggtgagagaaggcggcaccgctcctgcaacacggatgactgtccccctggctcccaggacttcagagaagtgcagtgttctgaatttgacagcatccctttccgtgggaaattctacaagtggaaaacgtaccggggagggggcgtgaaggcctgctcgctcacgtgcctagcggaaggcttcaacttctacacggagagggcggcagccgtggtggacgggacaccctgccgtccagacacggtggacatttgcgtcagtggcgaatgcaagcacgtgggctgcgaccgagtcctgggctccgacctgcgggaggacaagtgccgagtgtgtggcggtgacggcagtgcctgcgagaccatcgagggcgtcttcagcccagcctcacctggggccgggtacgaggatgtcgtctggattcccaaaggctccgtccacatcttcatccaggatctgaacctctctctcagtcacttggccctgaagggagaccaggagtccctgctgctggaggggctgcctgggaccccccagccccaccgtctgcctctagctgggaccacctttcaactgcgacaggggccagaccaggtccagagcctcgaagccctgggaccgattaatgcatctctcatcgtcatggtgctggcccggaccgagctgcctgccctccgctaccgcttcaatgcccccatcgcccgtgactcgctgcccccctactcctggcactatgcgccctggaccaagtgctcggcccagtgtgcaggcggtagccaggtgcaggcggtggagtgccgcaaccagctggacagctccgcggtcgccccccactactgcagtgcccacagcaagctgcccaaaaggcagcgcgcctgcaacacggagccttgccctccagactgggttgtagggaactggtcgctctgcagccgcagctgcgatgcaggcgtgcgcagtcgctcggtcgtgtgccagcgccgcgtctctgccgcggaggagaaggcgctggacgacagcgcatgcccgcagccgcgcccacctgtactggaggcctgccacggccccacttgccctccggagtgggcggccctcgactggtctgagtgcacccccagctgcgggccgggcctccgccaccgcgtggtcctttgcaagagcgcagaccaccgcgccacgctgcccccggcgcactgctcacccgccgccaagccaccggccaccatgcgctgcaacttgcgccgctgccccccggcccgctgggtggctggcgagtggggtgagtgctctgcacagtgcggcgtcgggcagcggcagcgctcggtgcgctgcaccagccacacgggccaggcgtcgcacgagtgcacggaggccctgcggccgcccaccacgcagcagtgtgaggccaagtgcgacagcccaacccccggggacggccctgaagagtgcaaggatgtgaacaaggtcgcctactgccccctggtgctcaaatttcagttctgcagccgagcctacttccgccagatgtgctgcaaaacctgccagggccactag

SEQ ID NO: 412 - DNA, 1638 bp, Homo sapiens
  CDS (325)..(1353)
aagaccagcacaagccatgtttccatatccaagacaacccactcccaaccagtcaccagagactgtcatctccggtgcacctggaccaagtggtttgacgtagacttcccatcccctggaccccacggcggggacaaggaaacctacaacaacatcatcaggagtggggaaaaaatctgccgccgacctgaggagatcaccaggctccagtgccgagccgagagccacccggaggtgagcattgaacacctgggccaggtggtgcagtgcagccgtgaagagggcctggtgtgccggaaccaggaccagcagggacccttcaagatgtgcctcaactacgaggtgcgtgtgctctgctgcgagacccctaaaggttgccccgtgacctccacacctgtgacagctcctagcacccctagtgggagagccaccagcccaactcagagcacttcctcttggcagaaatccaggacaaccactttggtgacaaccagcacaacctccactccacagaccagcacaacctctgctcctacaaccagcacaacctctgctcccacaaccagcacaacttctgcccctacaaccagcacaacctccactccacagaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgctacaagcagcacaacctccggttctggaactactcccagccctgttaccaccaccagcacagcctctgtttcaaagaccagcacaacttctgcttctacaaccagcacaacctctggtcctggaactactcccagccctgttcccaccaccagcacaacctctgctcccacaacaagcacaacctctgcccctacaaccagcacaacctcggccccaacaaccagcacaccctctgcccctacaaccagcacaaccttagctcctacaaccagcacaacctctgcccctacaaccagcacaacctctacccctacaagcagcacaacctccactccacagaccagcacaacctcggcttctaccaccagcataacttgtggtcctggaactaccccaagccctgttcccaccaccagcacaacctctgctcctacaaccagcacaacctctgccgctacaaccagcacaatctctgcccctacaaccagcacaactttgtctcgctacagaccagcacatcctgtactactataaccagcacaacttactgcccctatgagcagcagcatgcttcacctgaactttgaacaacaaaaggacactctgccccaggacttgcctggggtggacatacaggccacttcccacctgtttgacaccctcaggatgtagataagtcaggactagatgtttgatccccgagtgctgaccaggacagagatgtcaagcttttgtggatggccttaaggccctgtttgatttagaccttcctttctgctcacagactggacccctggcaggggtgcaccatagcgg

SEQ ID NO: 413 - DNA, 752 bp, Homo sapiens
  CDS (285)..(623)
cgggttcaccccccccccaccacgcgcccccccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctgaaaaaaaaaaaaa

SEQ ID NO: 414 - DNA, 1100 bp, Homo sapiens
  CDS (408)..(1004)
ggctaccccgaggctccaacagcctccccgctaaccgcccctcctttacccctaagcccttgcaaaccggtactaactggccccgaggatctctaacgccctccgattagactatggagcatctcttcctcctgaagatacccctcccgtaccacctagatcccttatgaagaatctaagtgtgctccagtaaaatcaatggttgcaatcctgatttaaagcgttttcctcagttccggaaagctcaaaagacatgcggtttacactgagcccaggaacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatgattcaagtggaagatgacttttaaaataatattttttaaatatatatttttaagtagtatgactaaaataaagatgaaccagcaaaaaaaaaaa

SEQ ID NO: 415 - DNA, 1127 bp, Homo sapiens
  CDS (159)..(1112)
tgggaaacgagagccccagctgctccaggttggggccgtgggggctccctaaggaggggacaccagggccccaatgtttcacagaggggcggggggcagcgaccctgggcagcatggcctcaggctgaagcccgatctggcatttccttgtgctcataatgagaatagttctccaattagccaagatgaacctcatggacatcaccaagatcttctccctcctgcagcccgacaaggaggaggaggacactgacacagaggagaagcaggctctcaatcaagcagtgtatgacaacgactcctatactttggaccagcttttgcgccaggagcgttacaaacgtttcatcaacagcaggagtggctggggtgttcctgggacacccttgcgcttggctgcttcttatggccacttgagctgtttgcaagtcctcttagcccatggtgctgatgttgacagcttggatgtcaaggcacagacgccacttttcactgctgtcagtcatggccatctggactgtgtacgtgtgcttttggaagctggtgcctctcctggtggtagcatctacaacaactgttctcccgtgctcacagctgcccgtgatggtgctgttgctatcctgcaggagctcctagaccatggtgcagaggccaacgtcaaagctaaactaccagtctgggcatcaaacatagcttcatgttctggccccctctatttggccgcagtctacgggcacctggactgtttccgcctgcttttgctccacggggcagaccctgactacaactgcactgaccagggcctattggctcgtgtcccaagaccccgcaccctccttgaaatctgcctccatcataattgtgagccagagtatatccagctgttaatcgattttggtgctaatatctaccttccatctctctcccttgacctgacctcacaagatgataaaggcattgcattgctgctacaggcccgagccactccacggtcacttctatcacaggtccgtttagtcgtccgcagagccttgtgccaggctggccagccacaagccatcaaccagctggatattcctcccatgttgattaactacctaaaacaccacctgtaatcttgcagtctg

SEQ ID NO: 416 - DNA, 1156 bp, Homo sapiens
  CDS (524)..(931)
gcagctgtggctgcctgggttattggaagtcatggagcccctgtcatgggaagaaatgctcacgttatcttcagggagtttcaggaggtttttggctcaaggcacccaactgtcaggcacaaagaaagcattgtgtccctaccctcactgctctcctgtgcccaggttattaacacaaattccattattgtcaaggctttggctagaatggcttgttcctgctggggctgaccattagaactgagatggaggaacaaaagctcccccgatcccgatcctaaccttccacccagtcccctcccactccccaggtcccataaagtggcgggagcatcgtagcgtaggaagaagccgccacaccttcctccataacctgggaggatggaagagctcttcgaagctttgctcttcgtgtccccctgaaacaagggttactgtgagtcttgcacacaaggaacatgcgctccaaggttcctagccaggtgggtgctctgcaaagttagggcaaagagagtctggccacatgcagcctctccactggagaaggattttcatctgccaggtggcggggcccttagcctcgttaatcctgcttaatcctgctagaacatacctacagggagcccactttccacgcagagcatcccttgaaggaggggcttcccagaatgctgaggattctgggcttctcagactccgatcagatgcacctcagccctgggatcagtgccccagccctgcctgccagtttcctttttcacttcaccatgagcataagtttgggtgggaactcagcctgttcattcacttcatactgagttcccactctgtgccagggcctgacctgtgcactgccaaaagagcagggaacagcaaaaccctttcctcccaccgtgggccttggagaatgaatgcagggggtggccacgggtagtcgtctggggcttggttctccctgagctaacctcgccagcctggcccagcttgccctgatcccctgatggtccgtgcacatgtgtttatacttgcattgttgactggggtccaattgcctttttggcaaaggcatcaagcattcaaagatgttcagatcttttctgtctggctcttttcctcggaatgaggctccagtgtgtccctttagtcccttagccat

SEQ ID NO: 417 - DNA, 2129 bp, Homo sapiens
  CDS (1820)..(2044)
ggggactggctctcagtaatcccacgtaaggtacctgccgtcggaagatttgaactttctacttggacaactaacacccacagtcctccaggtgggtcctaaggatcttaggagcaacgatggggggtcctaagccagggggggatgagggtctggctctcagtccctgcctcgcggggggtgcctcccccctctgcgatgggggtcctaagagccagtgggggaaccaggggctggctctcagtccctgcctcgcgggggtgcctccccctccctgcgatgggggtaccaacagccaggggcggaagaggggatagctctcagtccccaccctcgtggggttgcctccccctcctgcgatgggggtcctaagaacccgggggggaaagagggactggctctcagtccctgcctcgcggggggtgcctccccccctgcgatgggggtactcacagccaggggcggaagaggggatagctctcagtccccactctcgtggggggtgcctccccctcctgcgatgggggtccccagagacagggtggggaagagggactggctctcagtaatcccacgtaaggtacctgccgtcggaagatttgaactttctacttggacaactaacacccacagtcctccaggtgggtcctaaggattcttaggatcaacgatcgggggtcctaagccgggggggaagagggtctggctctcagtccccacctcgcggggggtgcctccccctcctgcgatgggggtccccagagccagggggggaagagggactggctctcagtccctgcctcgcgggggttcctccgcccccagcgatgggggtcctaagagccaaaggggggaagaggggctcgctctagtccccgcgtcggtgaggggtgcctcctcccctgtgatgagggtgcaaagagccaggggaggaaagggggaggttcgcagtccccgcctcgcgggatttgcctcccccactgcgatagtggtcccaagagccaggcggggaagaggggttgctctgagtccccgcctcgcggggggttgcctccccccactgcgatgggagtcccaagagccaggggggaagaggggatggatctcagccatcacaaaatggggggcctttatattcaggttttacccaagaatcagcttatttgcttcttgtactagcagggcagttgctgccaaggccctctaataggggggccatcctttagaaacctgtctagttgtttagagacgtaggctaccggcctcagccagggccccacagtttgggttaaaagtccagctgccatcttttctctctctgacgcatacaatggaaaaggctttgtcagatcgggtagccccagggctggggctgccagaagtttttcctttaactaatgaaagacttgctgttgtcgggatccccatttcaaagtttccgggtccccgccccctttgtgacctcatacaaaggcttggctaatactgcaaagtttgggatccacagtctacaaaaccccacagctcctaagaattctctcacctgccttctgcccttaagctccggtagattgcaaataacctgctttctttctgttcccgagctgcgttcggacccatgtcttattgtaaatcccacgcaaggtacctgccgtcggaagatttgagctttcttcttgaacacctcatacccacagtcctccaggcgccagtgggatcaagagagggcaacattgcaactctccatgctcctgcaatatccatggctattctgtagacagaaagacaacaggtacaaagccctaaggattataaaggtatgctgcttaccatcatcttagtgaccaaggcagcgaagctgtttctgtaccttggaacagtcttccctgacaagccagagaacagtgataaagccaccagccttgggatcaggactgaaaaggcaagagtgatggagatttctcctgcgctaagccaagagaaggtttcagcacttcagacagctcccaccgaagtagccgcgctcccagctgcttgcagatgttgaaaaggaaagcctcggtttgtcttgaggttgtcagcaggtgcaagacacgtaataaaatgcaatgtgttcctaaaaaaaaaaa

SEQ ID NO: 418 - DNA, 1783 bp, Homo sapiens
  CDS (118)..(1392)
agctgagtcgagctcgccggagcgggcacctctgtcagcctcctcgcagttgtagttattgtgtgtggcgtggccctggtggcagattttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcatccacacgtccccagatatcccagctgatgtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaggctgagacacttgtcatgtggtcagatctgtcttagtcttttgtgtctcccaaggtgatgtttttgtggtttttcactttttatgggtctgctggtaagaaaagggaaaaaaaaaaa

SEQ ID NO: 419 - DNA, 1762 bp, Homo sapiens
  CDS (118)..(1371)
agctgagtcgagctcgccggagcgggcacctctgtcagcctcctcgcagttgtagttattgtgtgtggcgtggccctggtggcagattttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcatccacacgtccccagatatcccagctgatgtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaggctgagacacttgtcatgtggtcagatctgtcttagtcttttgtgtctcccaaggtgatgtttttgtggtttttcactttttatgggtctgctggtaagaaaagggaaaaaaaaaaa

SEQ ID NO: 420 - DNA, 1718 bp, Homo sapiens
  CDS (161)..(1675)
tttcgtctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcccttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagacccaccaggctcttactttccccaacattttatcctcaagaccagaatgcgactgtatttgcacctgagaaatctctgaatgttagatctcaggctcccatgataaccgtactggtttc

SEQ ID NO: 421 - DNA, 1221 bp, Homo sapiens
  CDS (319)..(543)
aaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcaaaaaaaaaaa

SEQ ID NO: 422 - DNA, 2820 bp, Homo sapiens
  CDS (265)..(2577)
gtctcgaattcccgggtcgacgatttcgttagagagacagctccgcgcagtaagtgcggactgccagccaccagccttggcagccagctcgtcgcctccagccccgaccccgacattcatgcccaggagaaggctgcactgggtccctctgggcctttcctaaaagggagatccctgttcactagatgagttccagaaccatccactaaggctttgtagcccccttccatcagctgaccttcactgcatcccctatcgctcaagatgagtggcttcttcacctcgctggacccccggcgggtgcagtggggagctgcctggtatgcaatgcactccaggatcctacgcaccaaaccagtggagtccatgctagagggaactgggaccaccacggcacatggaactaagctagcccaggtactcaccacagtggacctcatctctcttggcgttggcagctgtgtgggcactggcatgtatgtggtctctggcctggtggccaaggaaatggcaggacctggtgtcattgtgtccttcatcattgcagccgtcgcatccatattatcaggcgtctgctatgcagagtttggagttcgagtccccaagaccacaggatctgcctacacctacagctatgtcactgttggggaatttgtggcatttttcattggctggaacctgatcctggagtacctgattggcactgcggccggagccagtgctctgagcagcatgtttgactcactagccaaccacaccatcagccgctggatggcggacagcgtgggaaccctcaatggcctggggaaaggtgaagaatcatacccagaccttctggctctgttgatcgcggtcatcgtgaccatcattgttgctctgggggtgaagaattccataggcttcaacaatgttctcaatgtgctgaacctggcagtatgggtgttcatcatgatcgcaggcctcttcttcatcaatgggaaatactgggcggagggccagttcttgccccacggctggtcgggggtgctgcaaggagcagcaacatgcttctacgctttcattggctttgacatcatcgccaccactggagaggaagccaagaatcccaacacgtccatcccttatgctatcactgcctccctggtcatctgcctgacagcatatgtgtctgtgagcgtgatcttaactctgatggtgccatattataccattgacacggaatccccactcatggagatgtttgtggctcatgggttctatgctgccaaattcgtagtggccattgggtcggttgcaggactgacagtcagcttgctggggtccctcttcccgatgccgagggtcatttatgccatggctggtgacgggctccttttcaggttcctggctcacgtcagctcctacacagagacaccagtggtggcctgcatcgtgtcggggttcctggcagcgctcctcgcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtgggtctgctcatttattttggatatggcatctggaacagcaccctggaaatcagcgctcgagaagaggccctgcaccaaagcacgtaccaacgctacgacgtggatgaccccttctcagtggaggagggtttctcctacgccacagagggcgagagccaggaggactggggcgggcccactgaagacaaaggcttctattaccaacagatgtcagatgcgaaggcaaacggccggacaagtagcaaagcgaagagcaaaagcaaacacaaacagaactcagaggccctgattgcaaatgatgagttagattactctccagagtaggagaaacacacaagtgggtagaaatggtgatgactgattttcagtaacttaacctgtgggctagaaggtgaaaacttttttggctctcatttcacaaatccagccttccccaaattcaatccctagtcatagcctgtcatttgctacttttgctcttcaggatagttctgttgaagggcttaacctgggtcccctaactggtcgccttgttaaataaaataaataaataaaaaaaaaaaa

SEQ ID NO: 423 - DNA, 1372 bp, Homo sapiens
  CDS (59)..(961)
gggcagtcggcggctgcctccggcggaggtgcctcgcggcgcctcggcggcgtgctccatgcatccggagcccgccccgcccccgagccgcagcagtcccgagcttcccccaagcggcggcagcaccaccagcggcagccgccggagccgccgccgcagcggggacggggagcccccgggggccccgccaccgccgccgtccgccgtcacctacccggactggatcggccagagttactccgaggtgatgagcctcaacgagcactccatgcaggcgctgtcctggcgcaagctctacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcatggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacctccaaaaaaaaaaa

SEQ ID NO: 424 - DNA, 2686 bp, Homo sapiens
  CDS (47)..(2416)
tttcgttttgggatcaccagtcggagcccttcgtgttacagctagaatgggtactaggaaaaaagttcatgcatttgtccgtgtcaaacccaccgatgactttgctcatgaaatgatcagatacggagatgacaaaagaagcattgatattcacttaaaaaaagacattcggagaggagttgtcaataaccaacagacagactggtcgtttaagttggatggagttcttcacgatgcctcccaggacttggtttatgagacagttgcaaaggatgtggtttctcaggccctcgatggctataatggcaccatcatgtgttatgggcagacgggagctggcaagacatacaccatgatgggggcaactgagaattacaagcaccgggggatcctccctcgtgccctgcagcaggtttttaggatgatcgaagaacgccccacacatgccatcactgtgcgtgtttcctacttggaaatctataatgagagcctgtttgatctcctgtccactctgccctatgttggaccctcagtcacaccaatgaccatcgtggaaaaccctcaaggagtcttcattaagggcttgtcagttcacctcacaagtcaggaggaggatgcattcagcctcctttttgagggtgagaccaacaggattatagcctcccacactatgaacaaaaactcttccagatcacactgcattttcaccatctacttagaggcccattcccggaccttatcagaggaaaagtacatcacttccaaaattaacttggtggatctggcaggctcagagaggctggggaagtctgggtctgagggccaagtcctgaaggaagccacctacatcaacaaatcgctctcattcctggagcaggccatcattgcccttggggaccagaagcgggaccacatcccctttcggcagtgcaagctcacccacgctctgaaggactcgttagggggaaactgcaatatggtcctcgtgacaaacatctatggagaagctgcccagttagaagaaacgctatcttcactgagatttgccagcaggatgaagctagtcaccactgagcctgccatcaatgaaaagtatgatgctgagagaatggtcaagaacctggagaaggaactagcactactcaagcaggagctggctatccatgacagcctgaccaaccgcacctttgtgacctatgaccccatggatgaaatccagattgctgagatcaactcccaggtgcggaggtacctggaggggacactggacgagatcgacataatcagccttagacagatcaaggaggtgttcaaccagttccgggtggttctgagccaacaggaacaggaagtggagtccactttgcgcaggaagtacaccctcattgacaggaatgactttgcagccatttctgctatccagaaggcggggcttgtggatgttgatggccacctagtgggtgagcctgaaggacaaaactttggactcggagtcgcccctttctctaccaaacctgggaagaaagccaagtccaagaagacattcaaagagccactcagctccttggcaagaaaggaaggtgccagcagccctgtgaatgggaaggacttggattacgtttccacctccaagacccagctggtcccatcctccaaagatggggatgtcaaagacatgctttcgcgggaccgggaaacttccagcattgagccccttccctcagactccccgaaggaggaattacgcccaattaggcccgacaccccaccctccaaaccagtggcctttgaggagtttaagaatgagcaaggtagtgagatcaaccgaattttcaaagaaaacaaatccatcttgaatgaacggaggaaaagggccagcgagaccacacagcacatcaatgccatcaagcgggagattgatgtgaccaaggaggccctgaatttccagaagtcactatgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctgctcatggaatttgacatctggtacaatgagtcctttgtcatccctgaggacatgcagatggcactgaagccaggcggcagcatccggccaggcatggtccctgtgaacaggattgtgtctctgggagaagatgaccaggacaaattcagccagctgcagcagagggtgcttcctgagggccctgattccatctccttctacaatgccaaagtcaagatagagcagaagcataattacttgaaaaccatgatgggcctccagcaggcacatagaaaatagaacctcatcgccagtaccttaaaggacaagaccagcaactcccacctactgtagtggagctgctcaaccacctgcccagagctgcagccccctctactccaatgctgggacccagcacagagaacacatttggcctgcatgttgggaggagcatcctccaaggacaaccttgctcatctccacagagcactttgggttttaattcactgtcttatatgcagggacaggataaaataactttctagtttggactttcaaaaaaaaaaa

SEQ ID NO: 425 - DNA, 3245 bp, Homo sapiens
  CDS (1187)..(3070)
atggggcccagaagggtagggttaggggcggggacggtgctggggatgctgagggtcgccctggaaacctctgggaagattttccagaggggtagtagtaatgaagaaattggaggtggggcccgctatgaggaccgaatgacagagcagcacctgttggctgcatatgataatcaggctactgttacacctaagactcacacagcagagaaaggagccttgggaaggagcccctctggcctgaaagatcaagcctattgctgggcatggccagtcagcctccgccgcagcccaggaagccagccgggacgccgccgccccggaccccgcgccctaacctccacctcgggggcctgcacccccagattgaatcgggaattccggaaacccgagcctggaaccctgatctgggaccagcaccccgagatccggccgtggaaccccaagatctggagcctgaaccccagtatatggggctggaatctcaacatcggtcactgggacctcaatatttggagccggaaccccacaatttggaacacagaccccaatatttggagcagaaccccaagatttgacatctaaaacctcaagcctggagctgaactctgaattctgggcctgggaccttgaaatctgggactggatttccagtactgtaccctggaacccactcttggggacctgaaccctgggattcaggcctcaaattccaagatctggactgtgggattccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatcccaagactggacctgggagaccctgaccctgaacaacccaaactggacccgtaaaactggaccctagaggcccaatatttaggggtctggaaccccgagtattaaggtctggagactccgttgccacagatttgagccgagtcaggacacagtccctctacagaagccttggggacaggaaaagcatgaccagatgctccctccagagccctgacctctgactcccctggagctaggactctgctccctggggctgcttctagctcaggacacccctgcccgcgatggccatcctcccgttgctcctgtgcctgctgccgctggcccctgcctcatccccaccccagtcagccacacccagcccatgtccccgccgctgccgctgccagacacagtcgctgcccctaagcgtgctgtgcccaggggcaggcctcctgttcgtgccaccctcgctggaccgccgggcagccgagctgcggctggcagacaacttcatcgcctccgtgcgccgccgcgacctggccaacatgacaggcctgctgcatctgagcctgtcgcggaacaccatccgccacgtggctgccggcgccttcgccgacctgcgggccctgcgtgccctgcacctggatggcaaccggctgacctcactgggcgagggccagctgcgcggcctggtcaacttgcgccacctcatcctcagcaacaaccagctggcagcgctggcggccggcgccctggatgattgtgccgagacactggaggacctcgacctctcctacaacaacctcgagcagctgccctgggaggccctgggccgcctgggcaacgtcaacacgttgggcctcgaccacaacctgctggcttctgtgcccgccggcgctttttcccgcctgcacaagctggcccggctggacatgacctccaaccgcctgaccacaatcccacccgacccactcttctcccgcctgcccctgctcgccaggccccggggctcgcccgcctctgccctggtgctggcctttggcgggaaccccctgcactgcaactgcgagctggtgtggctgcgtcgcctggcgcgggaggacgacctcgaggcctgcgcgtccccacctgctctgggcggccgctacttctgggcggtgggcgaggaggagtttgtctgcgagccgcccgtggtgactcaccgctcaccacctctggctgtgcccgcaggtcggccggctgccctgcgctgccgggcagtgggggacccagagccccgtgtgcgttgggtgtcaccccagggccggctgctaggcaactcaagccgtgcccgcgccttccccaatgggacgctggagctgctggtcaccgagccgggtgatggtggcatcttcacctgcattgcggccaatgcagctggcgaggccacagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggatgatcccggcggagagccgctcgttcctgctgacggacctggcgtcaggccggacctacgatctgtgcgtgctcgccgtgtatgaggacagcgccacggggctcacggccacgcggcctgtgggctgcgcccgcttctccaccgaacctgcgctgcggccatgcggggcgccgcacgctcccttcctgggcggcacgatgatcatcgcgctgggcggcgtcatcgtagcctcggtactggtcttcatcttcgtgctgctaatgcgctacaaggtgcacggcggccagccccccggcaaggccaagattcccgcgcctgttagcagcgtttgctcccagaccaacggcgccctgggccccacgcccacgcccgccccgcccgccccggagcccgcggcgctcagggcccacaccgtggtccagctggactgcgagccctgggggcccggccacgaacctgtgggaccctagccaggcgcccccccctctaagggtcctctggccccacggacagcaggacccggacaccctgtgggacctggcctcaaactcaccaaatcgctcatggtttttaaaactctgatggggagggtgtcggggacaccggggcaaaacaagaaagtcctatttttccaaaaaaaaa

SEQ ID NO: 426 - DNA, 1412 bp, Homo sapiens
  CDS (348)..(1409)
cggtatgcatctgagatataaagaagaaaaagccacagctccttccttcgtgatgctcatagtctgttagaggaagaattcagtgtcctggcaggttacaatggtaccatctttgcatatgggcaaacaggcagcgggaagacattcactatcacagggggtgcagagcgttacagtgacagaggcattatcccaaggacactgtcttacatttttgaacagttacaaaaggacagcagcaaaatatatacaacacacatttcctatttggaaatctacaatgaatgtggttatgatcttttggatccaagacatgaagcctccagtttggaagatttgccactcctatgaaccaagcttcaacccgttcccactgcattttcaccattcatttgtcaagcaaggaaccaggatctgcaactgtacgacatgccaaactccatctggttgacctggctggttcagagcgagttgcaaagactggagtagggggccatcttctaacagaggccaagtatatcaacttgtcactacattacttagaacaggttatcattgccctttcagaaaagcaccgttcgcacattccttatagaaactccatgatgaccagtgtcctaagagacagtttgggagggaactgcatgacaactatgattgcaacactctccttggagaaaaggaatcttgatgagtctatatcaacctgcagatttgcacagcgagtggcactcataaagaatgaagctgttcttaatgaagaaattaaccccagattagtgattaaacgcctacaaaaggaaatccaggaactgaaggatgaactggccatggtcactggggagcagaggacagaggcactcacagaagcagagctccttcagctggaaaaactaataacatcctttttggaagaccaggattcagacagtagattagaggttggcgcggatatgcgtaaagttcatcactgttttcatcatttaaagaaactattgaatgacaagaagatccttgaaaacaatacagtctcctctgaaagcaaagaccaagattgtcaagaaccattaaaagaagaagaatatagaaagctacgagatattctgaaacagagagataacgaaatcaatatcctggtcaacatgttaaaaaaaaaaaaaaaaaaagctcaggaggctctccacttggctggcatggatagacgtgaattcagacagtcccagagcccacccttccgcctaggaaacccagaagaaggtcaaagaatgcgactatcctcagctccctcacaggcccaggacttcagcattttggggaaaagatccagtttgctccacaagaaaataggtcagttgactaaatttccagtatttctcattgtctgtaatggatttcgatgtagcaccctttag

SEQ ID NO: 427 - DNA, 2191 bp, Homo sapiens
  CDS (59)..(1357)
ccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgatatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaatttaaaaaaaaaaaaatcctaaagggaaaaaaccgaccaggtgtggatctgcatgccacgctgccgtctgtgttacagtggtgttgctatttccaaggaagtgctgctttctttttttttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttgaaaaaaaaaa

SEQ ID NO: 428 - DNA, 3173 bp, Homo sapiens
  CDS (1)..(2997)
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgcgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaaaaaaaaaaaa

SEQ ID NO: 429 - DNA, 1716 bp, Homo sapiens
  CDS (223)..(1521)
tgtcgttgttctgaggtggccaggatcccaggcagtaaattgtgcggcggggtctggatggaaaggcggggcccgctgaaagaaggcgacccgagttctgctacttcctagtaagggacgtctctggagagattctgaggtgtttgagcctcttttgcctacacaccggcagtgtccttcccgcactcagagggcctctctggagccagttccaggccacccatgggccttggccccgccccctactcatggctggcagattcgtggccccacccatctcgaagcccctcggcccaggaacccaggggaagctgctgccctagcaatcctgacccggacgacagatattacaacgaagcaggaatctccctgtatctagctcagacggccaggggcacggccgcccctggcgagggtcctgtctatagcaccattgacccagcgggggaggagctgcagaccttccatgggggcttcccccaacatccctcaggagatctgggtccctggagccagtacgctcctccagagtggagccagggggacagtggagccaagggaggcaaagtgaagcttctggggaaacctgtgcagatgccctctctgaactggccagaagccctgcccccacctcctccttcttgtgaactgagctgcctagaagggccggaggaggagctggagggcagctcagagccagaggagtggtgcccgccaatgcctgagagaagtcacctgacggagcccagctccagtggagggtgcctggtcaccccatcccgaagggaaaccccctctcccacaccttcctatggacagcagtccacagccactcttacaccctcacctcctgaccctccccagcccccaactgacatgccccatctccatcagatgcccaggagggtgccccttgggccgagttcccctctcagtgtatcccagcccatgctgggcatccgtgaagcgaggcctgctggcttgggtgctggccctgcagcctcaccccacctcagccccagtcctgcccctagcacagccagcagtgccccaggcagaacctggcaggggaatggggagatgactcccccacttcaaggaccccgtgctcgattccggaagaaacccaaggctcttccctacaggagggagaacagtcctggggacttgcccccaccacccttgccaccgccagaggaagaggcgagctgggccctagagctgagggcagcaggcagcatgtcctccctggagcgggagcgcagtggggagaggaaagcggtccaggccgtgcccctggcagcccagcgggtgctccacccagatgaagaggcctggctcccatacagcagaccaagcttcctgtcccggggccagggcaccagcacatgttccacggccggcagcaactcttccaggggctccagcagctctaggggctcccggggccctggccggagccggagtcagagccggagccagagccaaaggccaggacagaaacgccgagaggaaccaagatgacccttgttggggcattgagaatatcatgagtgccacggggaaggggagtagggatgtcttttcccccccagcagtgatgagtggggctagctgaagcccattggtttccacgatttcaattggctgagaaggcagagagctagctcctccctttctttctttttccacctgagacttgtttataaaaaaaaa

SEQ ID NO: 430 - DNA, 389 bp, Homo sapiens
  CDS (163)..(288)
  misc_feature (1)...(389): n = a,t,c or g
tgtcgttgttctgaggttccagtttctccatccttgccaacacttgttatcacttgctattttccttttaaaaacaactgtagccatcttaggaatagcttagtttttgacagaagtaaataccaaggtaattaaatttttaagttctgagtattagaggtaatggttactgtagctcctaaaatgcacatcacatctctggtaggtgctggaaccctcatggtactgctgcttttaattttgcttttggaatgtttctttgtagctgaagctttagtgatgagaagttagaaatactctcattgacctttagtgttttgtcctgtgatatatatcaagtcgcttagtttgacattgttngaacttatttcctaagcaaaaaacagcag

SEQ ID NO: 431 - DNA, 2408 bp, Homo sapiens
  CDS (229)..(519)
acatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtccggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactcatttgattgttgtttatgtgtactgtcctcaaattagtccttagtc

SEQ ID NO: 432 - DNA, 2730 bp, Homo sapiens
  CDS (473)..(2086)
gactagtgattaagatgacagcagggatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggcgcggcatctttcttgaatgttttttctctacacagacttctttctttccttggtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaa

SEQ ID NO: 433 - DNA, 2018 bp, Homo sapiens
  CDS (1)..(1746)
atggggagcctgacgtcagccctcgcggccgccttccgcccgcccgcgcatccatctgggcctcagcgtgtcccgagcaatcacaacagcagccgcacaacaacaactcacttttacggcctccttagtggcaggcactgttctgagcgccttacgggcgttccctcctcagcatctcaccacgtgcggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccgttcatcgacgatttcatcctggccctccataggaagatcaagaatgagcccgtggtgtttcctgaggggccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccaggccacccggcagcacactcatcccgcgcctccagagggccccacccctcaatgcaacagcccggccccgcaaggccaggggggctgggtgactgcagacagcgactcccagagcatgccgctattcgagacatgaatgagcgcaactgtgcgacactgtccatgtacatgaatgaaatggatgtcagtaggaagatttggaggacgggatcccaggagccatatccatctttgcccatccttggcctacca

SEQ ID NO: 434 - DNA, 901 bp, Homo sapiens
  CDS (173)..(874)
tcattgttcctccagcgcctggcacggctgggccgaagcagagaccgtggcctgaagcgcgccatccccttcggagttgaccgaccaccaagctcttccgcccacaggtgttgtcagagctccttccaccggccggactggccgctcggccgcgcgcgggtcggccggctctatggggaaagcggcggctccgagccgaggcggcggctgtggcggccgctcccgcgggctctcgtcgctgttcacggttgtcccctgcctgtcgtgccacacggcggcgccgggcatgagcgcttccacgtccggctccgggccggagcccaagccccagccccagcccgtgcccgaaccggagcggggaccgctgtcagaacaggtgtcggaggcagtttcggaggcagtgccaagatcggaacctgtgtccgagacgacgtctgagccggagccaggggctgggcagccatcggaactgctgcaggggtcgcggccggggtcagagtcaagctcaggtgtaggggctgggcccttcactaaggccgcatcggagccgctctcccgggcggtggggagcgcgacctttctcagacccgagtcaggatcgctgccagcgttaaagcccctgcctcttctgcgaccaggacaggcgaagactcctcttggggttccaatgtcggggactggcacgacctccagtgccccactggccttactgcctctggacagcttcgagggctggcttctcaagtggaccaactatctgaagggctaccagcgccgctggttcgtgctgggcaatggtttgctctcttactacaggtatggaagcgccagggtgggacatgggggttggagggtggtgatgctgcagggatggtgatggagggcctccatggttggcgga

SEQ ID NO: 435 - DNA, 842 bp, Homo sapiens
  CDS (250)..(693)
tgtgcctggcatcagtcttgccctctcccctttggccacgcggcccttctcagcgatttgcagcagacccgcagggcagtgtgcctcggtggcattgaactgaagcttggctctcggcctggcctgctggctagttgcccaccctgtgggtcccgcccagagcaaggatactggagctttcgcctgcctcactgagcctgggtctccactccagtcatccctccagctactttgcagcactctgtcgccatgagcacctcgtctgcgcggcctgcagtcctggcccttgccgggctggctctgctccttctgctgtgcctgggtccagatggcataagtggaaacaaactcaagaagatgctccagaaacgagaaggacctgtcccgtcaaagactaatgtagctgtagccgagaacacagcaaaggaattcctaggtggcctgaagcgtgccaaacgacagctgtgggaccgtacgcggcctgaggtacagcagtggtaccagcagttcctctacatgggctttgatgaggctaaatttgaagatgatgtcaactattggctaaacagaaatcgaaacggccatgactactatggtgactactaccagcgtcattatgatgaagatgcgggcattggtccccacagccgggaaagcttcaggcatggagccagcgtcaactatgatgactattaaagcttctgaggtgcccacaagagcttgtgcctggttcaataaggccttctctacctataccacggtgacatcaggctaaaggaaagatataagtgctttttgcatttcatgcatgtggctacgaaatgctcacttaaaatagaaat

SEQ ID NO: 436 - DNA, 1016 bp, Homo sapiens
  CDS (182)..(811)
  misc_feature (1)...(1016): n = a,t,c or g
gaataaaatttatattgaattacaaactgtttgcacaaaagtcaagaaaaacttgaaagccttatatcaagaagcattcttcccatccaaacttcagtggtgcatttattttggatttgaccctctggggaaggggcatggcctctctcgacaagaaggttctggggaccaggcagagagaatgaggtctcaggatgacttccttgacagccctgttcgcctttcatcaacacacagacccagaagacctctctgtcttgtagcatctgccatgagaatcaggctcctgtgctgtgtggccttttctctcctgtgggcaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgacggggctagcgggagtccccacaccggggagctgttttttggagaaggctctaggctgaccgtactggaggacctgaaaaacgtgttcccacccgaggtcgctgtgtttgagccatcagaagcagagatctcccacacccaaaaggccacactggtgtgcctggccacaggcttctaccccgaccacgtggagctgagctgattttttcatagactatgagcttctaaaaaatcatccccatattcgtcattacattcttgggatcaaatatactgcatgaaaaaagatgctcagaaaagtctatgttaagttaatgtagaatatatgaatgagtgaaggaaagtgttttgaaaccatcatagggaatataataagataanattacactagaataaaatgaaac

SEQ ID NO: 437 - DNA, 691 bp, Homo sapiens
  CDS (236)..(655)
cgctcgaagtcgctaggacttctctcaaacttgtgtgctgaggagactcgatgtggacctcagctcctaggctgaaatcagcagactggctcatgaaaacttgtgtactgagacaaaggaaaggatctagcagaaagcaacgtctcttatcctgggcttggcagcaaggaagaggacaagtagtggaaatccttcaatctgaaaagcaaactgaaaggtgacaaagaagctgaagatgggtggcggagagaggtataacattccagaccctcaatctagaaatgctagtaagaaccaagaacagcaaaatagacagaagagcaaggatcagaattcttcccagacgaagattgctcataagaaaaaggaacgaggacatgggtacaatccagcagcagcagcatggcaggccatgcaaaatgggggaaagaccaagagcctttctaacaactccaactggaatgctggtttatcaagtcctagcttgctttttaagtctcaagctagtcagaactatgctggagccaaatttagtgaaccaccatcaccaagtgttctccccaagccaccaagccactggggttatgtttccttgaacccttcagataaggaaacgatgacatttcaacttaaacccttacttaagggacagggataaagttagtaggcgttaacttttaattgcgacgct

SEQ ID NO: 438 - DNA, 1688 bp, Homo sapiens
  CDS (1183)..(1584)
ttattattgtgaacttagtgacaagtgtggcactattacccatttccttgtctgcccccaaccctggggtcttgggcagagaacaggagttcttgccattttctcccagctcccaccttgtgctggcttgcgggtgctgaggtcatatttgctgggtgagagggtgcaggccagatatgagccaggcctggcagagagggttttggtcagcagtgatacctgcagtgttctctgcagttggtttgggctggccctgctcctgagaactcctgggttgtcccttcaggcaaccagggaaggctccttggagcagcagcatctccccttaccactcgccgacaccagcttccgcctgacccagagaaggagtttggggacagccacagcacgtccagggctcccaaggcagctggcagagccaatgaggagaccccaacacccatccgacggctgcagctctccctgacgtgtgtcacccgcagccctggtcccagccgctgtgcttctcagggcctgcctgcccagcccgggtggatatggtgcccaggcgggccccggggacacaatgagggccattctcagagccaggcagagcgtgtggggcagtcctgtcagtcctatgtgcaacagctgggatattgtttagggagtgctggcatcaggctggggctctcctcctctggccctgccctttgggatgagcaagcccccaaaggccttcctgggttcctctggtgcacgtgccctggagttacccttctgaaggaggtagacttgtcctcctgtcctgggtgcctggggtgcaggggtgtgaattgggctatgtcaagatatgctgggcagtactgtgaggtgggggcagaggggagaaggtgtcccaggaggagccttcctggaggggatgatagtccagcatgttctgaagtgggagtagggtgcggcaggagtagggtaccagagaatgagtgagtcaggcagcagcctccactgcgccttggacacaggtggctgacagtgtccacctggactggctttgcaccccttctgaggtcacagttgtgtcccttgaaaacttgggcaggagcacctgactggcccagcttgggtcatgccctaggcccagcagtgcgggaggccaggaaagtaggcttggggaggctggcctctcctccagtttgaagcatggcaggggttccgggggaggctgctggggggcctgcgagcatgtccagagcaggaatgcttggggtggtgtgtgctttgctcgtctgggcttatctggccgtggggaagctggttgtgcggatgacgttcactgagctgtgcacgcatcatccatggagtctgcggtgtgagtccttttgccgctccagggtcacagcctgcctccctgctccagccccctggctgaggcccttcctctgccccatgctcttctcagacaggaatcctgtggaatgtcatctctttggggaggccgtctctgaccctgtatgcaaaggccttctcccacattatttttggcaccccactttcttccccgtgaaagcaaattgtttggtgtctttctgtcccactacagtataggcccggttcagacagaggccttgtccactaggcctgcgctatctctgcggagcccagccaaagcaggggccaggcgaatcttttgttaaaagaacaatgcg

SEQ ID NO: 439 - DNA, 816 bp, Homo sapiens
  CDS (13)..(399)
  misc_feature (1)...(816): n = a,t,c or g
cggcttgcgaacatgcggccccttaagcccggcgcccctttgcccgcactcttcctgctggcgctggctttgtccccgcacggagcccacgggaggccccgggggcgcaggggagcgcgcgtcacggataaggagcccaagccgttgcttttcctccccgcggccggggccggccggactcccagcggctcccggagcgcagaaatattcccaagagactctaacttaaaagacaaattcataaagcatttcacagggccggtcacattttcaccagaatgcagcaaacatttccaccgactctattacaataccagggagtgctcaacgccagcttattacaaaagatgtgctagattgttaacaagattagcagtgagtccactgtgctcccagacctagcaaaactaccctacatttcctaagaatgtacatctaatttgaagaaaaagtgcctcaaatcatgcaaaatgtaaaaaaagatgaaatttatatttttatggatattaagatgagtaaaataagagacttcccagaaataactggttagctgtttcctgtcatagaatggagnctttcttgctttatctttttgtgtatacagtaatttataattttgtaaaacagagtttgaatcgcatattgaaaattagatattaaaaattgtgtgagtgtattttatttttactagatatattattttctttatatgggtaacattctaattaaacatttaattgtgtaaattatatctgtgagtgccagtgagaaataatgacctttttgaatatgactgttagcatatatgtgccatac

SEQ ID NO: 440 - DNA, 5140 bp, Homo sapiens
  CDS (13)..(3741)
ggaggcaggaggatggagtgcagcggcggtgacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctggcctgggcccagaatcgctccctgcagctgtcggaacacacgctctgtgcttaccccagtgccctgcatgctcatgccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccgctgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggagggccccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggcagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaa

SEQ ID NO: 441 - DNA, 3792 bp, Homo sapiens
  CDS (106)..(2253)
atgagttttccgcttcatcatctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagaggatgaagaccctccaagtgaaggaccaagctataactacccgagttcaggtaagaaacctcgtctacacagtcaaaatcaacccaactttagagctaagctcaggttttaggaaggaactccttgacatctctgaccgtctagagaacaaccagacgaggatggccacctacctggcagaactcctggtgctcaactatggcacccacgtcaccaccagtgtcgacgctggggctgctcttattcaggaggaccacctcagggcctccttcctccaagacagccagagcagtcgtagtgccgtgaccgcctctgctggacttgcctttcaaaacaccgtgaacttcaaatttgaggaaaactatacctcgcagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctgacttgccaggccccctggtgaagaaggtgtcaaagacagtggaaactgctgtgaagcgctattatacattcaacacctaccctggctgcacagatctcaattctcccaacttcaattttcaggccaacacggatgatggctcctgcgaggggaaaatgaccaacttctctttcggtggggtttatcaggaatgcactcagctctcagggaatagggatgtcctcctctgccaaaagttggagcagaagaatccactcactggtgatttctcctgcccctctggctactccccggtgcacctgttatcccagatccacgaggagggttacaaccacctggagtgtcatcgaaagtgcactctcctcgtcttctgcaagaccgtgtgtgaagatgtgttccaggtggcaaaagctgaatttagggctttttggtgtgtggccagcagccaagtacctgaaaactcaggactgctttttgggggcctcttcagcagcaagagcataaaccccatgacaaatgcacagtcatgcccagccggctactttccactgagactctttgaaaacctcaaggtatgtgtttctcaggactatgagttgggaagcaggtttgcggtcccctttggcgggttctttagctgcacagttgggaaccccctggtagatcctgctatatccagagatttaggggcactgtctctgaaaaagtgccccgggggcttcagccagcacccagccctcatcagcgatggatgccaagtgtcctattgcgtcaaatccgggctcttcacaggagggtccctgccccctgccaggctcccacctttcacccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaacctgtctgaatttcacactcttagagcctggaagagccctgaaaagacacaagtcttgcctggctactgctttttaactttgagggctctatgttgacagactgttatctcctctgggtgacctcaaacatctgaaaagaaagatgttgcctgtgccaattccactttttccagctgccccttgatgaacactcccttataccagaccactcttggacttctgactggtgtcatcaagtcctcagaaaatattttaagttattttaagttattaaggaagggatgatttggagacaaggagtaatgaaagatgggtaaaaactggaaaagattctggtgctaagtactaccccttcatcttccatggatggtcattacctttcctgtcctcctgttatatgaacacacacacacacacacacacacacgcacaccacatttcaatgtctgcatggttctgggggtaacaaaggcaagaagttaaagtaagaccacatttgagtattacttactctgtagaatcaaaacagagtagttaacaccaattatgcaaactacttttttttccagcagaaagggagctgacatgatcaaatccatgttttcaaatgaactgaaaaaggcatccagcaccacttataacacatttatttcagttccaggctgacagccctggggcatctagcaggatgcataattgtcatctggtgagagttgggactttgctcaattttaataccaatctctcctgattgtaattacctccactactttcatgatccccctacaatatttttttaaatgatatatttattcactgaatcaaatgtcattaatgagttatcttctgtggaggatgactgttctctttgttaatgttcacaatcaagatcttgggctgagaagaggcccttcacccaaggagtttgaagtatcacagcgtgtgggaaggtgggaaccaggatacccattcatttccaaccgagacacagagaagtgagtcacagaatttgagcccgctctcttgactgcccagccagagacactgatttctgtaacctcttcacttgatcctgcctcttaagcattaaaacattctcctaaacctctgagtgga

SEQ ID NO: 442 - DNA, 1107 bp, Homo sapiens
  CDS (415)..(615)
cctggggtaattcttctgccttctttcttgcatatttataaatttgtaagtgctgtgcacgtggattcttggcaagcatgtggaagcttaagcttaagatttgatttttctgatattataggccaatcactttggatattagatttttaagattgattttggaatttctcatccattagcaggttttcacctttctccttaaactcatagttttacttgaaatcatacagcatatttgtagcaatctgacagcataaatatacacaacacaaatggaacgacttatgaaggaattacttgtgaaagctcattggagtaaaatttcctctcaaacaatactttaggtcatatgactgagtctattaactatttttctgttataccctgccagaaaagaattttaaaagttagtttatgttttgtgtaaccatgttcttcagaatgcaggtatgtgagcatcatggtttctgggtaattctgctgctcctgtctttgaaaatggagataccacttgcagcttatcccactgctgagtattccagcattggtagtggtttcactccattgcatccatccagaactttcacacaggcctccccattacccagcattttttaacattgatcaataaggcctataaccagatttaggctagcaacaccagaggtctgggggcaagggtggaaattgactttacattcttagtagctaatattccataagtgctttatatatatattgttgttattgatcatctattcaaaaaatatatattgagcagctgctgtggtataggctctgtgctggccagtgaagatacatgattgacaatgttgtgcttgcttggttcacagtcctgtgggtacatggtggagtaaaataagtacaattaatttctcagagctgtgcacagcaacacacagaaggagagataactcacccagcttttgaggggtgggacagagaatgatgctagcctaccacatgtccttgtgctatctctagctgttttcacgcgttgataaaagctccaggagctggcaggattagagcagaagaacctccagcttacaacgcgcggaggccatgagaggttttcataccccg

SEQ ID NO: 443 - DNA, 928 bp, Homo sapiens
  CDS (23)..(559)
agtcgtcggccccatccgcgcgatgggctctgaggcggcgcagctgctggaggctgccgacttcgcggctcgcaagcaccggcagcagcggcggaaggaccccgaggggaccccctacatcaaccaccccatcggtgtggcacggatcctgacccacgaggcgggaatcactgacattgtggtgttacaggcggccctgctccatgacacggtggaggacacagacaccaccctggatgaggtggagctacactttggggcacaagtgcggcgcctggtggaggaggtaacagatgacaagactctgcccaagctggagagaaagaggctgcaggtggagcaagcgccccacagtagccccggggccaaactggtgaagctggcagacaagctgtacaatctgagggacctgaatcgctgcaccccagagggatggtcagaacatcgagtccaggaatacttcgagtgggcagcgcaggtggtgaaggggcttcagggaacaaaccggcaactggaagaggctctaaagcatctgttcaagcagcgggggctgacaatctgatcagtgcttgaagctatccagaggcacaactccagcctcgttcaggccggacaggattcatacgccatcttttctgtgtctcctgagctccctccatccttcccagatattagaggccaaaaaaagacttgcattttttctcagtctgaaggtctcctgctaactaagctgagccccgcgtggtgggaatcagatgtacccatccatttctgatgcactcaccgcctctccccaagtcttgggtctgtttgctattttgcatggtgggatctctggcccctcagggacttgagattatttaagtactagttcctaacacgttctggaaaataaaaataactctgggttaaggtttaaaaaaaaaaa

SEQ ID NO: 444 - DNA, 1897 bp, Homo sapiens
  CDS (404)..(829)
ggcacgaggagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggccccctagtctggctcccctctggcgccccagccccggagcccaatgcccgagcccgagcctcccgccctgtgctggcccacggccagcgccgacgcggagctgagcgcccagctgagccgtgcggctggacatcaactgagggcgctgcgctggccccggcgctgcatgggtcttcaacccctacactggagttcccggagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccacagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctaaaaaaaaa

SEQ ID NO: 445 - DNA, 603 bp, Homo sapiens
  CDS (235)..(495)
gcacgagggaacgtctgtctctgtgtctgagtaaggcgtgtgcaccggagggaggttcgggtgggcatcgggcgggtggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctgtatgataattccgctgttagagattctaataataattgtgttgaatgaagtgctcctttttgatgtaaactcagtttacaaagcacttttatgtacattgctcttgcattttcaaaacatcagaagatttctgtcttctcagtcccctatgaaagctgtgagccttcttccttttcatcaacctgactttgattatatattaaattatttctctgtggccttttgggaaatgggcaatgagttggtcatatcattcatgttatgaagcacctatattataatggtggtgttcataatactgtcatacccaaagaattgtggaaagcccttaaaaaataaaagcaacatgtttagttaaaaaaaaaaaaaa

SEQ ID NO: 446 - DNA, 1629 bp, Homo sapiens
  CDS (22)..(1512)
aagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgccgttcctggggcgcaggctgcccccggccttcaaacacctgcgggtcgtagcgaagagggctggccagccaccccatgtcctggaagaaggccctgaagcctcaagcagctggcaggccgcccacagctgcaccccagagccgccagcgcctcggtgaggccccgtgtccacaggaggccacctcggtgtgaatggaaggaaacgctgcctctgcttgcgtgactctgctccccgattctccagagccccgtggttgctggcttgaataaaa

SEQ ID NO: 447 - DNA, 1662 bp, Homo sapiens
  CDS (22)..(1545)
aagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggaagttgttatttaaagatggcagttattacgaaggggcgtttgtggacggagagatcacgggagaaggccgccggcactgggcctggtcaggagacaccttctctggacagtttgttctgggagagcctcaaggctacggcgtcatggagtacaaagccggcggatgttatgaaggggaggtctcccacggcatgcgggaaggtctggcgcccacaggagccgggtgctgtgagggacacgggtttctggtggaccgggatggacaagtgtaccagggctccttccatgacaacaagaggcacggccctgggcagatgctctttcagaacggtgacaagtacgacggcgactgggtccgggaccggcgtcagggacacggggtgctgcgctgcgccgacggctccacctacaagggacagtggcacagcgacgtcttcagtggactgggcagcatggcccactgctcaggggtcacctattatgggttgtggatcaatggccacccagcagaacaagctacgaggatcgtgatcttgggtccggaggtgatggaagtggcccaagggtctcccttctcggtgaacgttcagctgctgcaggaccacggggaaattgccaagagcgagagcggccgggtcctgcagatctcagcgggcgtcagatacgtgcagctgtcagcctactctgaggtcaactttttcaaagtggacagagacaaccaagagacactcatccagaccccatttgggttcgaatgcatcccttatcctgtgtccagccccgcagctggggtgccggggcccagagctgccaagggaggggcagaagccgacgtgcccctgcccaggggagacctggagctgcatttgggtgccctccatggccaggaggacacccctggtggcctgcttgccaggggacatgcgccccattgtcccggggcctgtcagcgagtggagcagggctgtgccgagttcacagatgtcctcctggggccgcccccgcctgggtaccaccccttcctgttcctggacagcctccacaagaaggcaggcggcagatccagaggcggcctgcaccccagggggacaccacccacggcacaggagcctcctggaggcagcaggcctgaggggagagccacggaggagcaggctgcggcagcacacctaggggagtacgtgctcatgatccgcgacgtgaccaccccgccgttcctggggcgcaggctgcccccggccttcaaacacctgcgggtcgtagcgaagagggctggccagccaccccatgtcctggaagaaggccctgaagcctcaagcagctggcaggccgcccacagctgcaccccagagccgccagcgcctcggtgaggccccgtgtccacaggaggccacctcggtgtgaatggaaggaaacgctgcctctgcttgcgtgactctgctccccgattctccagagccccgtggttgctggcttgaataaaa

SEQ ID NO: 448 - DNA, 4871 bp, Homo sapiens
  CDS (1)..(3015)
atggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcagccccgtcccaggtggtggtgatccgtcaagagcgggcggggcagaccagcgtctcgctgctgtggcaggagcccgagcagccgaacggcatcatcctggagtatgagatcaagtactacgagaaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccggccccgctatgacaccaggaccattgtctggatctgcctgacgctcatcacgggcctggtggtgcttctgctcctgctcatctgcaagaagaggcactgtggctacagcaaggccttccaggactcggacgaggagaagatgcactatcagaatggacaggcacccccacctgtcttcctgcctctgcatcaccccccgggaaagctcccagagccccagttctatgcgcaaccccacacctacgaggagccaggccgggcgggccgcagtttcactcgggagatcgaggcctctaggatccacatcgagaaaatcatcggctctggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggccgcctggcaatgattgtgactgagtacatggagaacggctctctggacaccttcctgaggacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacgggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccaggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccgagcccaccccaggtcatgccagcggcagaggacgtgaggggctggcagcaggcagggcggccccaggcctctgccctcctctcgggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacgcctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacaccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatcttt

SEQ ID NO: 449 - DNA, 2479 bp, Homo sapiens
  CDS (183)..(2279)
acactgcctcggttcggcaagtgggtcagttggctggggctcacttggcaacgggacgcgggaacgaggggcgcggacgcaggcccgggaggacgcggcggcgggaacctgggggcgcagggctagggcagcgggcccgacccgcacggctttcctggaaagcgctgcccctcgccgcggcgatgacctcgctgtggagagaaatcctcttggagtcgctgctgggatgtgtttcttggtctctctaccatgacctgggaccgatgatctattactttcctttgcaaacactagaactcactgggcttgaaggttttagtatagcatttctttctccaatattcctaacaattactcctttctggaaattggttaacaagaagtggatgctaaccctgctgaggataatcactattggcagcatagcctccttccaggctccaaatgccaaacttcgactgatggttcttgcgcttggggtgtcttcctcactgatagtgcaagctgtgacttggtggtcaggaagtcatttgcaaaggtacctcagaatttggggattcattttaggacagattgttcttgttgttctacgcatatggtatacttcactaaacccaatctggagttatcagatgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttggaggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgatttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccatcattttcatatgaatactcccaaatactttttatgaaacatttaaaacaagaagttattggctgggaaaatctaagaaaaaaagtatgtaagataaaaagaagagattaatgaaagtgggaaaatacacatgaagaacctcaacttaaaaaacacatggtatctatgcagtgggaaattacctccatttgtaaactatgttgcttaataaaaacatttctctaaaaaaaaaaa

SEQ ID NO: 450 - DNA, 2041 bp, Homo sapiens
  CDS (333)..(1955)
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggacgccgaggccgcggtcgcgggcccatcccacgcccctgatacgtccgacgtcggggccacgctgcttgtgtctgacgggacccacagtgtccgatgcctggtgacgcgggaggccctggacacctcggactgggaggagaaggagttcggcttccgcgggacagagggccggctgctgctgctgcaggactgcggggttcatgtccaggtcgctgagggcggcgcgcccgcagagttctatctccaggtggaccgcttcagcctgctgcccacggagcagccccggctacgggtgcctggtcgcaaccaagacttagatgttcagaaaaagctctatgactgccttgaggagcacctttcagagtccacctcgtccaatgcaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacgggagaagctgtgtacactgtccccagctcaatgctgtgcatctctgagaatgaccagctaattctgagctctctaggcccctgtcagaggacacagggccctgagctgcccccaccagacccggctctgcaggacctatctctgaccctcatagcctctcctccttcctcacccagttcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggaacccccaaagaggcatcgtgatggttctgccttccagtatgagtatgagccaccctgcacgtccctctgtgctcgggtccaagctgtcaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaaaaaaaaaa

SEQ ID NO: 451 - DNA, 1142 bp, Homo sapiens
  CDS (49)..(840)
agagtgtccccctgtagacctgttagagtgctggaattcctgcagtaaatgcacaacccggacggaagtgcctctccgacagcagatccaggctcggagctccagacgctgggacaggccgcccgcagaccacccccgccgcgcgcgggacacgacgccccccgcaggacacgcccatcagcccggaaacccctgagctgcttctcccggaggccgatgcccacccgggagcccccaaagactcgcggctcccgggggcacctgcatactcacccgcctgggcctgggcccccgctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagcttaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccagaaggaggcccaagttgcagcccgggtttggagggagtttgagatgaagcgaatggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacaaaaaaaaaa

SEQ ID NO: 452 - DNA, 2678 bp, Homo sapiens
  CDS (266)..(1222)
agctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaagagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatcttcacttgctcagaaatggaatatgacagggagaagccaatggtatatacttccagaatgtccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactataaaatataaaaacaagaaataatactcaaaccattgtaaagttgctgactaggttgggtcacatttgaaaaacaggccagtatggactagtggtggagggaaaactttaaaaataataaccacaatgctgctgaaacagactcacaacaactcttaatttaaacatgtgtggttgaatttatttccctgcatgcattgtgttttgtaactagttatgtggcatgcagcatttggaaaatttttcttatttaccagtgtttgatttgtgatttttaaaaattgatacctttaccattgcagaaaagaacttgtgctttcccagtggcgtatgtgtattgtttcaactgtattattataattatattttgcattgcaagattcttgatgttaaaccaatccttgtaaagtgtaaaaaggaaccctcctatcgtggaatgaaagattaagtatattaacacttttcagaatgatagtttctgtatttgatgttgctcagaaatgtctgagtatttgagtaagttttacatgacagtgggtactgaaattaagtcattttgttcagcactttaacgctttcttatagaattgtcttaaaacttctggatccttgagcaaatgattatagtctcctgactttcatgaggcttccattaggaacagaatgattgcatgttgtccccagaacactgccaccttgctatgcgaatgatgttctcagcagcacttctaagaaacactcttaaaagttatttattgaaaatttttcgtatgcttttaatattttaaagaattgacctaaggaaagcttatgattggacttattttccaaccagataacatttactctaagtacccagtttttataatttatatgaaatcagatttcaacacttactttgtcattttgtagatcattttttttaaatactgtgtaaaaactttttttacacctaagctgtgtttttgatactgatattttcctatgctgaatagttttcttactttcagggaaggtaagaaaatactttttttatatttgttacttatgtaacattcatatttttctcattttgatatttgtaacatactgtatgctttctacttgtaaatgtcaacaatagaattaaaatatttatttaaaataaaaaaaaa

SEQ ID NO: 453 - DNA, 1929 bp, Homo sapiens
  CDS (143)..(1318)
ggaggaggcggcggcggcgggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggctgggaagtggaaccctttacatgtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggaaaaaaaaaa

SEQ ID NO: 454 - DNA, 3758 bp, Homo sapiens
  CDS (169)..(2685)
tttcgtgcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctggcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagagcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccagaacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggggttttaaaaaaaaaaa

SEQ ID NO: 455 - DNA, 2763 bp, Homo sapiens
  CDS (80)..(2449)
tttcgttgctgattgaggtcggcagctcccgagaagcaggagaagcagagtttttgcagacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagttgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagtttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaaaaaaaaaaaaaa

SEQ ID NO: 456 - DNA, 3511 bp, Homo sapiens
  CDS (75)..(2921)
aagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattcct

SEQ ID NO: 457 - DNA, 5279 bp, Homo sapiens
  CDS (99)..(3767)
ccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggacggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccattaaaaaaaaaaaa

SEQ ID NO: 458 - DNA, 2431 bp, Homo sapiens
  CDS (59)..(2017)
gggctccggagcacatgctgagcggagctgtgctggggctgctgcggcgtggcggagcatgcgctcgctccctcgctcactcgctcgctcgcagtggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccag

SEQ ID NO: 459 - DNA, 1866 bp, Homo sapiens
  CDS (66)..(1022)
gatttcgtattgttatttagtttttatttcataatcataaacttaactctgcaatccagctaggcatgggagggaacaaggaaaacatggaacccaaagggagctgctatcggctggcggcccacaagctgcttaaggagatggtgctgctggagcggctgcggcaccccaacgtgctgcagctctatggctactgctaccaggacagcgaggacatcccagacaccctgaccaccatcacggagctgggcgcccctgtagaaatgatccagctgctgcaaacttcctgggaggatcgattccgaatctgcctgagcctgggccgcctcctccaccacctggcccactccccactgggctccgtcactctgctggacttccgccctcggcagtttgtgctggtggatggggagctcaaagtgacggacctggatgacgcacgtgtggaggagacgccgtgtgcaggcagcaccgactgcatactcgagtttccggccaggaacttcaccctgccctgctcagcccagggctggtgcgagggcatgaacgagaagcggaacctctataatgcctacaggtttttcttcacatacctcctgcctcacagtgccccgccttcactgcgtcctctgctggacagcatcgtcaacgccacaggagagctcgcctggggggtggacgagaccctggcccagctggagaaggtgctgcacctgtaccggagcgggcagtatctgcagaactccacggcaagcagcagtaccgagtaccagtgtatcccagacagcaccatcccccaggaagactaccgctgctggccatcctaccaccacgggagctgcctcctttcagtgttcaacctggctgaggctgtggatgtctgtgagagccatgcccagtgtcgggcctttgtggtcaccaaccagaccacctggacaggtcggcagctggtctttttcaagactggatggagccaagtggtccctgatcccaacaagaccacatatgtgaaggcctctggctgacctatctgagggctcggctgaccagctgactatcctcagcagctgggcttgcctgtggagggagtgacttgcactggcagcactgcatgtcacctgggaacccctgcagacaaagctaacatcccagacagacagatgtgaccaggacaaacgtgcaataatgccaaatgttaaaatgtgagtttaccagcctagctatgggactgctggctcctagtccaggaatcatgggggtatgactgcctctccaaccctgtgggctgtaagcaagctcaggctagtctccccactgggggctgtgcccctccctgggacggttccgtgggcagccccatcactgtgttcaatagtgtgagaatgtagctaaagcccctgctgctgctgctgcacatgccacagcaggcggtgggggctgcgtggggacaatccatcgtggagtgttctctcagcttaggtctggacaggagacttggcgggagatgctccaggatgtgggtgattctgtacctggggaggctatctctgacctcccgacaggggacactcccaggccagcccaggggtcaggggcagaggtgcacacctcagcatgagccaagactggggtcagggagcaggtgtggtttgagccaggacctggggcgggggtggggccggggcctttctgcctcatttgctttcaatgaaagcctcaaagcagccaaaaccaggctttcccccttcctcgagtttgaatatccagaatcttttgtacttcttgttggttaaattgtttatttttgtaaaaaataaaataaaattagttaataaaatgatgtttcacagcaaaaaaaaaaaaaaa

SEQ ID NO: 460 - DNA, 916 bp, Homo sapiens
  CDS (125)..(631)
aaggatccttaattaaattaatcccccccccccccccgagtgtgctgagctctccgcgtcgcctctgtcgcccgcgcctggcctaccgcggcactcccggctgcacgctctgcttggcctcgccatgccggtggacctcagcaagtggtccgggcccttgagcctgcaagaagtggacgagcagccgcagcacccgctgcatgtcacctacgccggggcggcggtggacgagctgggcaaagtgctgacgcccacccaggttaagaatagacccaccagcatttcgtgggatggtcttgattcagggaagctctacaccttggtcctgacagacccggatgctcccagcaggaaggatcccaaatacagagaatggcatcatttcctggtggtcaacatgaagggcaatgacatcagcagtggcacagtcctctccgattatgtgggctcggggcctcccaagggcacaggcctccaccgctatgtctggctggtttacgagcaggacaggccgctaaagtgtgacgagcccatcctcagcaaccgatctggagaccaccgtggcaaattcaaggtggcgtccttccgtaatgactatgtgcccaaactgtacgagcagctgtctgggaagtagggggttagcttggggacctgaactgtcctggaggccccaagccatgttccccagttcagtgttgcatgtataatagatttctcctcttcctgccccccttggccatgggtgagacctgaccagtcagatggtagttgagggtgacttttcctgctgcctggcctttataattttactcactcactctgatttatggtttgatcaaatttgaacttcattttggggggtattttggtactgtgatggcggcatcaattattaatctgacaatagcaccccagg

SEQ ID NO: 461 - DNA, 3214 bp, Homo sapiens
  CDS (514)..(3138)
cgactctgtggatcccctgcctgctgtcgctaggacagctctcctggcttgctagattaatggccagcgtgtctcaagactcgaatcacggggctgtgaccgagaactctttggcggagggcatttcatagaccttaaggactctcagtgaaatgagacactatcaaaggctgcctgattatgtggagccgatttgcgcattgaatatcagaggaaaagaattatgtgcggcagtgttaggacagcaccagtaccgagctctgtcagagagcatgctcaccacaagagagtttttgaaggaaattagttatgagcttatcacaggaaaggtcagtttcctggcatcacatttcaaaaccacatcattaggcgatgacctagacaagctgctggaaaaaatgcaacaaagaagaggagacagtgtggttacccctttcgatggagaccttaatgaatgtgtgtcaccccaggaggctgctgctatgattcccacacaaaacctggatttagataatgaaaccttccacatttatcaaccgcagcaacagttgccagaaaactcttatcccaggtgtgtgctatagcggacagtggcagccagagcctggacctcggtcacttcagcaaagtagacttcatcatcattgttcccagatcggaggtgttggttcagcaaactcttcagcggattcgacaatcagtgtcatttcaggctctttgtcacatagcgaacccagtcatgggctagctgatagagtcattaattgcagagaagttctggaagctttcaacctcctggtgctccaggtcagctccttcccatacactctgcagacccaacagtcccgcattagctctagcaatgaggttcactggatacagctggatactggggaggacgtgggctgcgaggagaagctgtactttggcttgagtgagtacagcaagtctctgcagtgggggatcacgagcccacttctgagatgtgacgagacttttgaaaaaatggtgaacacactcttggagaggtaccccaggctgcacagcatggtcgtccgctgctatcttctcatccagcagtactctgaggccctgatggctctcaccaccatggcgtcactccgcgaccacagcacaccagaaacactcagcattatggatgacctcatcagctccccaggcaaaaacaaaagtgggaggggacatatgctcattatcagggtgccctcggtgcagctggcgatgttagccaaggagcggctacaggaggtgcgcgacaaactgggtctgcagtatcggtttgagatcatccttgggaacccggccaccgaactcagtgttgcaactcactttgtggcgcgattaaagagttggagaggaaatgaaccagaagagtggatccctcggacataccaagatttagacggtctaccttgtattgtgatattaactggcaaagatcctcttggagaaacctttcccaggtctttgaagtactgtgacctccggttaattgactcaagctatttaactcgcacggccttggagcaggaggtgggtctggcatgctgctatgtctcaaaagaggtcatccggggacccactgttgccctggacctcagcgggaaggagcatgagagagctgctgtcagtgagaatgactccgatgagctgctcatcgacctggagcggccccagagcaacagcagcgctgtcacagggacctcgggttccatcatggagaatggagtgagctcttccagcacagctgacaagtcccagaagcagtccctgacccccagctttcagagcccagccaccagcttggggctggatgaaggggtctccgccagctcagctggagccggagccggggagactctgaagcaggagtgtgactccctgggcccccagatggcgagcagcaccacctccaagccgtcatcatcatcctcaggacccaggaccctcccatggccgggacagcccatcagaggctgccggggcccacaggcagccctgccaccagtggtgatcctatccaaagcggcctacagtctcctgggctcccagaagagtggcaagctgccatcctcctcctccctgctgccccacgccgacgtggcctgggtgagctccctgcggccactcctgaacaaggacatgagcagtgaggagcagtccctctactacaggcagtggaccttggcccggcagcaccacgctgactatagcaaccagctggacccggcctctggcacccgaaacttcctcccccgacggctcctgctgacagggcccccacaggtgggaaagacgggctcctatttacagttcctcaggatcctcttccgcatgctcatcaggctcctggaggtggacgtgtatgatgaggaggagatcaacaccgatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaagaagtgataaaggaatccaaagttgaagagcccaggaaacgggaaactgtatccataatgctgaccaaatatgcagcctataacacctttcaccactgtgaacagtgccgccagtacatggacttcacctctgcctcccagatgtctgactccacccttcatgccttcacattctcttcttctatgctgggagaagaggttcagctctatttcatcattcccaaatccaaagagagtcattttgtcttcagcaagcagggcaagcacctggagagcatgcggctgcccctggtttcagacaagaatttgaatgcagtcaagagccctattttcactccttccagtggtcgacatgagcacggactcctaaaccttttccacgccatggagggcatcagccaccttcacctcctggtggtcaaagagtatgagatgcctctgtaccgcaagtactggcccaaccacatcatgctggtgcttcccggcatgttcaataatgcaggcgtgggtaaggggcccccctgggatggggagaagggcttcgaagataaactgagctccattcccctggcatgaaactttcagattcccctgcctctagaaattgtcctgccctcctcaccactcttcggaaaaaaaaaaaaaaaag

SEQ ID NO: 462 - DNA, 2897 bp, Homo sapiens
  CDS (63)..(1037)
cggtctcgtgccggctttccaggaccctcagggagagcgggcagccttccaggtggacagaaatggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatagatccttggtgtccaaaagagtactatgaagacattaagaaggattttccagaaggagacattcgactctgtgagaaaaacatacctcatgctttcatcacccattttaaccaggaaatggcagacatgattgctgactccctaaaggatgacttgtccaaaatgtaaattggcctgaggaacaagcccccactgccagtacatggaggcagtcagtgtactagacttagtaggtaaatgtttaattttgaagactgatattagaaatgaagaaagtgagaacctttgtcttacaaaccaactctccgctcgccatgttataggctgaagtaaacacagttgatgaatcattccataggtttaaccatacattttccaagactcagggaacacagtgatctacacagagtcttgtgtttgcacaagatgcccagtggcaccatatggtttattttggtaggcaggatctttgcagatgaaaaaaaaatctacatgtacttgattttaattgagttacattgtagaataggctcctctggaggaaattatgaaatacctactagaaaatgtaaaataaatcagtgaatgttaagagtatagttagatatgtgaagtgtatgagattatgacaaggatacactcatgttccaggagcaggaagtgaacctgggtctcctgtaagacagaagatgaagatgagcccaggctaacttagcacagatcttggctgagatcatcaatgtgacgtctaatgtacctgcactagacagagaataaagttcaccagacattactctggtcagctaaccagataaagaattgttgaaggaccccaactgtgcctcctgccacaggacaaccagcaagttctatgctgagccttagcctcccaggttataagctccctgcaggctcctcctctccagagccaggatggagaggcactgggctgtcccaaagcaggcttggatgtgccaacgtacagttgctccttctgtaattcttgcactaaaactccattaaagaccatcaatgagccaaatagtgtgctagccattgaggatggagttcttagctacttaatgattcttttcttctggaaatcttctagtgaataatttttaaaagcttcttttaaactgctcagtaaaacattgccatacattaactctccatttctgcattaacttcatttgctggaaagaaattattttgttaatgaaccaaacccagccattaagttatgtgaattcaccttctctagacacattgaggtatggcagagaagacacatattccctggcctagagtgggctgacaatattgctgcctcccctaaattgactcaatcttgagaaccacatactgcagtgacagttgatcatggatcagaaatattcctttttctcctagaggaaatccctcatggcattatcattccctaaggacaatgagatgtccctccgctcaaatcctaaagccccctgatgaaagatttggctctgatttgctgccaacttattggtaagtgctgaatgagttactgtgctttggcatagcttctacatcacagcaagtgacttctcagaggggaaaagccaagctccagacaaggagtgctgttagcccaaggggaagagctaatagatacataggccgtaagcacagggctgtacacagatcctttattggcatctgcatgagaggcctagaaatcggatgttagaagctaggaatcatggctctgagcgccttgcatacaggagatactcactgatactaaatcaaggcatgtaaacaatactgggtaaatcatacctaccagaataaagagtaacattcagagcttttcttttatctgttattttaaatgttactccatatttcaaaagtctgcacgtatgaaattgtgtcttatttctggtttttagagcctaagaaagatactcattcttaattcctatttatcatctgaaaaccaaatgaacttttgaaataaatgttttaccagcaaaaaaaaaaaaa

SEQ ID NO: 463 - DNA, 2540 bp, Homo sapiens
  CDS (478)..(1824)
tttcgtggcgggagcccgggcggccggtttgaactccgtgcacgcgggcctggagctgcgcccctgcgtcttttcccgacttctgatccgcagaggggcactcggagccccagcctgggtcgcagtgccttcggtctgcgggcctcagtttctcggtggcgcctggactctcgccctcagagggaggcccgtcccacggtctgtggctacggatcccaggaccctcttcgcgggcgattcgcgtagcctcagattgcctcggatgatggcctgcgactgacagtctctcagctcttctcagctctcctgaggctgcagctgtcagctccctgatcctcagcacttgcctggaccagtgcgggtctgccacgccctgttcagccatccctgtcctgttgtgtcgtgcaagccacatctgtccacacccccaccacccaccagtgctggctctcctctcttctcccctgtgctcccagcatgcctcgtggccggtgccgtcagcagggccctcgcattcccatctgggcagccgccaattatgccaacgcacatccatggcagcagatggacaaggcgtctcctggggtggcatacaccccccttgtggatccctggattgagcggccctgctgtggggacaccgtgtgtgtgcgaacgaccatggagcagaagagcacagctagtggcacttgtggcggtaaacctgcagaaaggggtcccctagctgggcacatgcccagctcccgaccccacagggtggacttctgctgggtaccaggctcagacccaggcacctttgatggctccccgtggctactggaccgcttcttggcccagctgggcgattacatgtccttccactttgagcactatcaggacaacatcagccgtgtctgcgagatcctcaggcgcctaacaggccgagcccaggcctgggcagccccctaccttgatggggacctgcccctgcctgacgattacgagctcttctgccaggatctcaaggaagttgttcaagacccgaacagttttgctgagtaccatgctgtggttacctgtcccctgcccctggcctccagccagctgccagtggcccctcagctgcctgtggtgaggcaatacttagctaggttcttagagggcctggcactcgacatgggtactgcccccaggtctttaccagccgccatggccacccctgctgtgtctgggtccaactctgtatctagaagtgctctgttcgagcagcagctgaccaaggagagcacccctgggcccaaggagcccccagtcctgcccagttctacatgtagctccaagcctggtcctgtggaaccagcctcttcccagccagaggaggcagcccccacacctgtccctagactgtcggagtcagctaatcctcctgcccagagaccagacccagctcatccaggaggtccaaaaccccagaaaacagaggaggaggttttggagacagagggagaccaggaggtgtccttaggtaccccacaggagctggaatgtgaggaaggctgcctggaggaagtggccactttgattctgggggatgagtgggatagcatcttggcaaagaatgatgtttcctgtgggattaccagcagttctgggcagctggaaggtttggatgcaggaaggtgggatgcaagccccttgccaggctcagctgcaggcattcgccctttgtgtgttaacactgtagctctaatcgtgcctggtgttctgaagcaggctcctcttccctgctgctgtgctgccatcccctgctcactccgcactcgcatgcattgcggattcagcacttaagccctagtgtgtaaatgacttggatctccctcctggcagactgtgaccctcagcacaggggctctgtcttagtcagctctgtggcctggtacacaattggtgctcattaaacacgtgttggattactggctgaggtggtgcagtggctgcctaccagcaagtctttgtttcccattctgtcaggagcagaggcctggccatgagcattccaggtcagcattgcagctgtggtttctggcaggggctttgagggtccaagggtctgatcaaagaagctgggtggggctgagtagggggtgggtggctctgcaggtagagaactgacttccgagagctgtaggtgaagtgaggaccaggcagcagtccagagctgtgaggccccaggcccagaggaatggaatgaagaaagacctgttccacacaaggaggggttttctagtggaagctgagcttggaagctcctggagccaagtttaccacaggataggcaggtacagccgcccagtgtgtgcagtgtgtgcccactctggtgcttggacaagaagttcaagtccctttcaggtttacaattgtgaaaacaacaaaacaataccttcctggaaagtaggaagacaaagcagaaatgtgaattggaaatacagccaactattttaggaaaaactaattagcaagcatctgattaaacttattcagatactgaaaaaaaaaaaaaa

SEQ ID NO: 464 - DNA, 3394 bp, Homo sapiens
  CDS (88)..(2268)
aagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgctctgacagcactgtgccctgcccctacagcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaaaaaaaaaa

SEQ ID NO: 465 - DNA, 1354 bp, Homo sapiens
  CDS (366)..(1121)
accacgctgcaggaattcggcacgaggccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacgctacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgtaaaaaaaaaaa

SEQ ID NO: 466 - DNA, 2787 bp, Homo sapiens
  CDS (1)..(2784)
atggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttgggctagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaccttctgtcttcaataacatattctcctaaattagagcgtaagacatcagagggcataataccaacagacagtgacaatgtgaagggagaaagaaacagcaaacgggtatgttttaatgtagcaggagatgaacaggaagattctggtcatgacaccatcagcaacagagactcttacagtgactgcaacagcaataggaattccatcgcctccttcaccagcatctgcagcagccagtgcagctcgtatttcacagtgatgaaatggactcaggtgatgaacttcccttaa

SEQ ID NO: 467 - DNA, 2173 bp, Homo sapiens
  CDS (140)..(1852)
ggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccagatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtatttatttttttaaaaaaaaaaaaa

SEQ ID NO: 468 - DNA, 2386 bp, Homo sapiens
  CDS (876)..(1598)
cgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttcttaccataaacgatggcaaagcacactttcttcagctgagaaaaagatttgatcagaaaagggcaacgattcagttttcaccaacctcagagatttaaggatgagctttggaggatccaggagaagctggaatgttactttggctccttggttggctcgaatgtgtacataactcccgcaggatctcagggcctgccgccccattatgatgatgtcgaggttttcatcctgcagctggagggagagaaacactggcgcctctaccaccccactgtgcccctggcacgagagtacagcgtggaggccgaggaaaggatcggcaggccggtgcatgagtttatgctgaagccgggtgatttgttgtactttcccagaggaaccattcatcaagcggacactcctgcggggctggcccactcgactcacgtgaccatcagcacctaccagaacaattcatggggagatttccttttggataccatctcggggcttgtatttgatactgcaaaggaagacgtggagttacggaccggcataccccggcagctgctcctgcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggaaagttaccgaggctggacagtgtagtgagactgcagtttaaagaccacattgtcctcacagtactgccggatcaagatcaatctgatgaagctcaagaaaagatggtgtacatctatcattccttaaagaatagtagagagacacacatgatgggaaatgaggaggaaacagagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaaaatagtgggtcttcgagtttaaaatagtcattgttattttacattctaaagtgcatgtaggttgatattttttaaaatatcattggagaatttaatctttctttataaaaatagagcatttttctgctttctggcaaaagttggggataaaaggaaaaaaa

SEQ ID NO: 469 - DNA, 1287 bp, Homo sapiens
  CDS (71)..(655)
tttcgtaggcggcgtccgcgacgcagctgttcacgcttaggtgggcgacgtgggcgcaggtgggcgcaggatggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagttgacggtgcagaagggcggaagccctgatgcggggagcttggatgaggagggctctgatccccccctgccggggagggcccagcgcatccgacaggtgctgcagctgctctcctagtgggttcagcgcggggcggggccgctgcccagtgcagggctgcctcagaccacacagggtgcagctcctccggcggtgggggccgggttcaccagcagggcagcggctgagcaagggctttcagctcctccggtggtgggggccgggatcaccagcaccagagcctcgcaagggccccttccctcctccagaccctccttggccggtgacggctgtgacagtgatggcaggttcagtgccttcagcgcagagcgtggatgctctggaatcacccggacccctggccttggagggaccctccagccccaggaatctgctttggagggaaatgtctatttttctaccgggaatattttagagattggggcatgctggctcctcccgccagctgcaaacctgcaccttccgcctgattcccgatccccctgcgtgggccgcattcctggtcccctgcctgcgtccatcgaggggcctggctgtggcctgttttcctttgaccccacacagcgtcattgcgggtcatggggagcccctggtgggagcttgtggagtcggatcacgtacctgtgcagaaaccgcctctgtggctgcatttgaaataaaacccgacccagcagcaaaaaaaaaaa

SEQ ID NO: 470 - DNA, 3218 bp, Homo sapiens
  CDS (448)..(2208)
cggcgccgcctcccagcccagagcccagcgctcaggaaggtgcgggcgggggagaaagcaacaccattgtttttcaggcgcctccatttgcccccgatgccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagggcctctgggacctgtgcggtggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtggtgaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttggcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcggatgttggactagaggaaagaagaaggcagggtgggactgatgggctcagtggggagcagggccaggcacactgagccagacatgtcatgtctgagccccagattcgtggccatcaggtaggcaggagcaccccgcagatccaagatgatcaggcagcccttttgggctggcctctgtggcaggggtctgcagagctccttcttgaggtttggaaacagtcgtcatacctgttgattttcctgggggccaatcactagggatctggagctcaccaaaaacaaagcttacattttaatttgtgttgcacacctaccccataatgtctttataccccaaagatccttggtaaatgcttgtgggttggaagcggagttgtcatcgtttaaaaggcacttaagtcccttcttccaatctgtcctgtctaggaatgtggagctctgcccccagtgaggggttctcctgtctgggtgagccaagctccagaacagaaccttgcctgacaacacacttgatagatacattagcttggagtgctggtgtgtccaaac

SEQ ID NO: 471 - DNA, 1129 bp, Homo sapiens
  CDS (209)..(1123)
ctgaaatcactacatagtaaaaaccttcagaagcccagaaaaaccaaggaatactggaattagaaagactatttttgagagccatgtgacagaccaagcagcccaccccacaaggatcccttcagcaagcaaagaacaaaggaaaaaagctctcacttgacatgttctcaaaacaatttgcctgctaaatgttaaagctatcaccctcatgttgtgtggaattgatatccatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcacatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagattccaaaaaagcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagag

SEQ ID NO: 472 - DNA, 894 bp, Homo sapiens
  CDS (292)..(681)
tttgggtttggacgggtgcgtttgtttttcatagtgcaggtctggagccggactgagatggggagtagagggaccccttgaaacttcagggtggatgaatatgaagtttcatcaccagctgtgatgtttgatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggagtgtgctggctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtaaaaaaaaaa

SEQ ID NO: 473 - DNA, 2257 bp, Homo sapiens
  CDS (127)..(1821)
atctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgtggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacactgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcttcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcatcgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctaaaaaaaaa

SEQ ID NO: 474 - DNA, 5246 bp, Homo sapiens
  CDS (120)..(5243)
acgaagcccacaaaaaatactactgctcagagcttcagatcgcaaagcccatctctgcaggcacccacacatctccagaagctgaaaagagtcagattgagcatgagccgtggtcccaaatgatgcattacaaactgggaaccaccctggaactcactccactgaggaagaggaggaaagagaagagccttggggacgaggaagagccacctgcctttgagtccacaaaaagtcagtttggcagccccgggccatctgatgctgctcggaaccttcccctggagtccaccaagtcaccagcagaaccaagtaaatcagtgccctccttggagggacccacgggcttccagccaaggactcccaagccagggtccggttcagaatcagggaaggagaggagaacaacgtccaaagaaatttctgtcatccagcacaccagctcctttgagaaatctgattctctcgagcagccgagtggcttggaaggggaagacaaacctctggcccagttcccatcacccccacctgccccacacggacgctctgctcactccctgcagcctaagttggtccgccagcccaacattcaggttcctgagatcctagtaactgaggagcctgaccggccggacacagagccagagccgccccctaaggaacctgagaagactgaggagttccaatggccccagcgcagccagacacttgcccagctcccagctgagaagctgccacccaaaaagaagaggttgcgcctggcagagatggcccaatcatcaggggagtccagcttcgagtcctctgtgcctctgcctcgcagcccgagccaggaaagcaatgtctctttgagtgggtccagccgctcagcctcgtttgagagggatgaccatgggaaagccgaggcccccagtccctcatctgacatgcgccccaaacccctgggcacccacatgttgactgtccccagccaccacccacatgcccgagagatgcggaggtcagcctcagagcagagccccaacgtttcccattctgcccacatgaccgagacacgcagcaaatcctttgactatggcagcttgtccttgacaggcccttctgctccagccccagtggctccaccagcgcgggtggccccgccagagagaagaaaatgcttcttggtgagacaggcctctctgagcaggcctccagaatctgagttggaggttgcccccaagggaagacaggagagcgaagaaccacagccctcatccagtaaaccctctgccaaaagctcattgtcccagatttcctctgcggccacctcacatggtggacccccgggaggcaagggcccagggcaggacaggcccccattggggcccactgtgccctacacagaagcactgcaagtgttccaccaccccgttgcccagacacccctgcatgagaagccatacctgcccccaccagtctcccttttctccttccagcatctcgtgcagcatgagccaggacagtctccagaattcttctccacccaggccatgtccagcctcctgtcctcaccatactccatgcccccacttcctccctccttatttcaagccccaccgcttcctctccagcctactgttctgcacccaggccaactccatctcccccagctcatgcctcacccagccaacatccccttcaggcaacccccttccttcctccccatgccatacccgacctcctcagcactgtcttctgggtttttcctgcctctgcaatcccagtttgcacttcagctccctggtgatgtggaaagccatctgccccagatcaaaaccagcctggccccactggcaacaggaagtgctggcctctcccccagcacagagtacagcagtgacatccggctaccccctgtggctcccccagccagctcctcagcacctacatcagctcctccactggccctgcctgcctgtccagacaccatggtgtccctggttgtgcctgtccgtgttcagaccaatatgccgtcctatgggagcgcaatgtacaccaccctttcccagatcttggtcacccagtcccaaggcagctcagcaactgtggcacttcccaagtttgaggaacccccatcaaaggggacgactgtatgtggtgcagatgtgcatgaggttgggcccggcccttctgggttaagtgaagagcaaagcagagctttcccaactccatacctgagagtgcctgtgacattacctgaaagaaaaggcacttccctgtcatcagagagtatcttgagcctggaggggagttcatcaacagcagggggaagcaaacgtgtcctttcaccagctggcagccttgaacttaccatggaaacccagcagcaaaaaagagtgaaggaggaggaggcttccaaggcagatgaaaaacttgagctggtaaaaccatgcagtgtggtccttaccagcaccgaggatgggaagaggccagagaaatcccacttaggcaaccagggccaaggcaggagggagctagaaatgctgtccagcctgtcctcagatccatctgacacaaaggaaattcctcccctccctcaccctgcattgtcccatgggacagccccaggctcagaagctttgaaggaatatccccagccatctggcaaacctcaccgaagagggttgaccccactgagcgtgaagaaagaagattccaaggaacaacctgatctcccctccttggcacctccgagctctctgcctctgtcagaaacgtcctccagaccagccaagtcacaagaaggtacggactcaaagaaggtactgcagttccccagcctccacacaaccactaatgtcagttggtgctatttaaactacattaagccaaatcacatccagcatgcagataggaggtcctctgtttacgctggttggtgcataagtttgtacaaccccaaccttccgggggtttccactaaagctgctttgtccctcctgaggtctaagcagaaagtgagcaaagagacatacaccatggccacagctccgcatcctgaggcaggaaggcttgtgccatccagctcccgcaagccccgcatgacagaggttcacctcccttcactggtttccccggaaggccagaaagatctagctagagtggagaaggaagaagagaggagaggggagccggaggaggatgctcctgcctcccagagaggggagccggcgaggatcaaaatcttcgaaggagggtacaaatcaaacgaagagtatgtatatgtgcgaggccgcggccgagggaaatatgtttgtgaggagtgtggaattcgctgcaagaagcccagcatgctgaagaaacacatccgcacccacactgacgtccggccctatgtgtgcaagcactgtcactttgcttttaaaaccaaagggaatctgactaagcacatgaagtcgaaggcccacagcaaaaagtgccaagagacaggggtgctggaggagctggaagccgaagaaggaaccagtgacgacctgttccaggactcggaaggacgagagggttcagaggctgtggaggagcaccagttttcggacctggaggactcggactcagactcagacctggacgaagacgaggatgaggatgaggaggagagccaggatgagctgtccagaccatcctcagaggcgcccccgcctggcccaccacatgcactgcgggcagactcctcacccatcctgggccctcagcccccagatgcccccgcctctggcacggaggccacacgaggcagctcggtctcggaagctgagcgcctgacagccagcagctgctccatgtccagccagagcatgccgggcctcccctggctgggaccggcccctctgggctctgtggagaaagacacaggctcagccttgagctacaagcctgtgtccccaagaagaccgtggtccccaagcaaagaagcaggcagccgtccaccactagcccgcaaacactcgctaaccaaaaacgactcatctccccagcgatgctccccggcccgagaaccacaggcctcagccccaagcccacctggcctgcacgtggacccaggaaggggcatgggccctctcccttgtgggtctccaagacttcagctgtctcctctcaccctctgccccctgggaagagaactggcccctcgagcacatgtgctctccaaactcgagggtaccaccgacccaggcctccccagatactcgcccaccaggagatggtctccaggtcaggccgagtcaccaccacggtcagcgccgccagggaagtgggccttggctgggccgggcagcccctcagcgggggagcatggcccaggcttggggctggccccacgggttctcttcccgcccgcgcctctacctcacaagctcctcagcagaagcccagagacctgcgcctccccgtggaaggccgagtcccgaagtccctcctgctcacccggccctgctcatcctctctcctcccgacccttctccgccctccatgacttccacggccacatcctggccctgacagaggagaacatcttcagccacctgcctctgcactcccagcacttgacccgtgccccatgtcccttgattcccatcggtgggatccagatggtgcaggcccggccaggagcccaccccaccctgctgccagggcccaccgcagcctgggtcagtggcttctccgggggtggcagcgacctgacaggggcccgggaggcccaggagcgaggccgctggagtcccactgagagctcgtcagcctccgtgtcgcctgtggctaaggtctccaaattcacactctcctcagagctggagggcggggactaccccaaggagagggagaggaccggcggaggcccgggcaggcctcctgactggacaccccatgggaccggggcacctgcagagcccacacccacgcacagcccctgcaccccacccgacaccttgccccggccgccccagggacgccgggcagcgcagtcctggagcccccgcttggagtccccgcgtgcaccggccaaccccgagccttctgccaccccgccgctggaccgcagcagctctgtgggctgcctggcagaggcctctgcccgcttcccagcccggacgaggaacctctccggggaacccaggaccaggcaggactcccccaagccctcaggaagtggggagcccagggcacatccacatcagcctgaggacagggttccccccaacgcttag

SEQ ID NO: 475 - DNA, 4964 bp, Homo sapiens
  CDS (282)..(1751)
atggcagagggtgagcgtatagggagtggtgagtacgtggccattgttgaagttgactaccctgggttaagtgttacaagtaccagtggtggtcagagctgctcgtctgaggctgctgaggcgacggccggtgtcgtggtcgcggtacctgttccaacacggctcgcgggcccgtgccggctccgggtccccggcgcggctgtccgagcccctgcggcgggcggacgatggtgtggcggagcacgcggacgcgggcggcgcggcggcgggcatgaaggaggatggaagggcaggacgaggtgtcggcgcgggagcagcacttccacagccaagtgcgggagtccacgatatgtttccttctttttgccattctctacgttgtttcctacttcatcatcacaagatacaagagaaaatcagatgaacaagaagatgaagatgccatcgtcaacaggatttcgttgtttttgagcacgttcactctcgcagtgtcagctggggctgttttgcttttacccttctcaatcatcagcaatgaaatcctgctttcttttcctcagaactactatattcagtggctaaatggctccctgattcatggtttgtggaatcttgcttcccttttttccaacctttgtttatttgtattgatgccctttgcctttttctttctggaatcagaaggctttgctggcctgaaaaagggaatccgagcccgcattttagagactttggtcatgcttcttcttcttgcgttactcattcttgggatagtgtgggtagcttcagcactcattgacaacgatgccgcaagcatggaatctttatatgatctctgggagttctatctaccctatttatattcctgtatatcattgatgggatgtttgttacttctcttgtgtacaccagttggcctttctcgtatgttcacagtgatgggtcagttgctagtgaagccaacaattcttgaagacctggatgaacaaatttatatcattaccttagaggaagaagcactccagagacgactaaatgggctgtcttcatcggtggaatacaacataatggagttggaacaagaacttgaaaatgtaaagactcttaagacaaaattagagaggcgaaaaaaggcttcagcatgggaaagaaatttggtgtatcccgctgttatggttctccttcttattgagacatccatctcggtcctcttggtggcttgtaatattctttgcctattggttgatgaaacagcaatgccaaaaggaacaagggggcctggaataggaaatgcctctctttctacgtttggttttgtgggagctgcgcttgaaatcattttgattttctatcttatggtgtcctctgttgtcggcttctatagccttcgattttttggaaactttactcccaagaaagatgacacaactatgacaaagatcattggaaattgtgtgtccatcttggttttgagctctgctctgcctgtgatgtcgagaacactgggaatcactagatttgatctacttggcgactttggaaggtttaattggctgggaaatttctatattgtattatcctacaatttgctttttgctattgtgacaacattgtgtctggtccgaaaattcacctctgcagttcgagaagaacttttcaaggccctagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgccagggacacaggttttcatcatttacaggctcttatgtgctagttttgttggtagcacgttatttaatgcataaaggcagaattcttacaagttttttttttttaatgtgaacatagatgcagcaccgactttttaaacttgaaaaaactggtataatgttaacttttaaaaataacatttggacacactagtaattgatttttgtttacagattgttttgtttacaaattgttagtctttgtttctatgagatacttttagtgtgactttttaaatgtcttagaaattaaaagttgtacaaaaagtgaaaaaaaaaaaaa

SEQ ID NO: 476 - DNA, 1776 bp, Homo sapiens
  CDS (20)..(1495)
tagagatttattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgactaaaactagtgcactgcatatattttatcttcatagaggtcagaactgttaataaaagttaaaggaatttacaaaaaaaaaaaaa

SEQ ID NO: 477 - DNA, 2565 bp, Homo sapiens
  CDS (169)..(1140)
gcctacagacactgacattttccccatcacctcactccctcacctgtacctcccaacgccaacatcctcccctctgctctcctcacattggaaattccaactccctcccacgtctccaccaggtgtcacaatcgcgctctcgccggctcctctccccgcccctccgggatggtagtgcggaagcggaagaggctgcagggccgggaagcctctgtttggtccggccaggtcccgggatccgggccgcccgctgcgatgccaagtccccggaggggcatggagggacggccgctgggcgtctccgcttcgagcagcagcagcagccccggcagcccagcccatggcggcggtggcggcggcagcaggtttgagttccagtccctgctcagcagccgcgccacggccgtggaccccacctgcgcccggctccgtgcatcggagagcccagttcaccgccgcggctccttccccctggccgcggcgggcccctcgcagtcgcccgcgcctccgctgcccgaggaggaccgcatggacttgaacccgtccttcctgggcatcgccctgcgctccctgctggccatcgacctgtggctgtccaagaagctgggggtgtgcgcgggagagagctcgtcgtggggcagcgtgcgaccccttatgaagctgctggagatctcgggacacggcatcccctggctgctgggcaccctctactgcctgtgcaggagcgacagctgggccgggcgcgaggtgctgatgaacctgctcttcgccctgctgttggacctgctgctggtggccttgatcaaagggctggtccgcaggcgccgcccggcccacaaccagatggacatgtttgtcactctctcggtggacaagtactccttcccctcgggccatgccacaagggccgccctgatgtcgaggttcatcctgaaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccaaaaaatcctctattgtatatttattcaacaactgtttatgtttccaggacaactgcaaagaaaacaagctgaggtggttatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaaggtacaggcacattttaggtcacagtatttaattggaaattcatcatgggagttgctggtatacaggcacaagatataatctccagaattttggtttaattgagcgttaatttaaagggtgatccctggggggtccccaatattagaggaagaaccaaaggggggggttgtgttaatattggggccaagatgggaagattgtctaaagtgggtactcgaagaaaattaaacatagggggggggggcaaaaagacatggggtaaacaaaaaggttgtctggtgaggagagatatttattgacaatcaatg

SEQ ID NO: 478 - DNA, 1810 bp, Homo sapiens
  CDS (154)..(1371)
cggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcagactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttatttggtatggcattgaccccctgtttaccaaaccaggtgtggggtttccttgtgtgggatgactgtgattgtagggggttgctgggtggccttcttattccctagcctttggtccatttcttatgatttcctttgaaggcaccaaatcttatctggaaataaattgttatggaggggctgtttttgagcaatactgcatattgaacaattctaaaagaccagtatctatgtatacttttaaaaaaaagatttgctaagatcaaag

SEQ ID NO: 479 - DNA, 1666 bp, Homo sapiens
  CDS (242)..(1663)
gaattcggtcgacgatctctgtaaagactgccgcgtgaactgaggagtcccggaccggtttgcttgctgcaaaggatccagtccagatcccaggagagcctctctgccccttcggacctcgtctcccatatacaaaacgagaagattggcccagttggcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggccgcgggaagagaatgacttgggccctgcaggcacggtggacagcagccagggccaggggtatctagaggagaaagcagccccctgctgcccggcgcacctggccttcatctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtgagtatccggccggtggcctcgtgggtgcttttcagcggctgcctcagctacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctag

SEQ ID NO: 480 - DNA, 2733 bp, Homo sapiens
  CDS (271)..(2730)
cttcctagcaggagacaaggagcaacgctgcggtggggagcaggctgtggggcccccacccccagccctagccaggcctagtgcctgctgtagcaccctagaagatccccagcagttggcactagctgtacccaccttgcctggggcccccgtgctgggggtcgcccccaagatggtggcggccccagggaggactgtactgccagccccagcctctggccgctaggcaccccctgccttgccctggcccctcactccgaggccagcgccatgctgcgcctggggctgtgcgcggcggcgctgctgtgcgtgtgccggccgggtgccgtgcgtgccgactgctggctcattgagggcgacaagggctacgtgtggctggccatctgcagccagaaccagccgccctacgagaccatcccgcagcacatcaatagcaccgtgcacgacctgcggctcaacgagaacaagctcaaagccgtgctctactcctcgctcaaccgctttgggaacctcaccgacctcaacctcaccaagaacgagatctcctacatcgaggacggtgccttcctgggccagtcgagcctgcaggtcctgcagctgggctacaacaagctcagcaacctgacggagggcatgctgcgaggcatgagccgcctgcagttcctctttgtccagcacaacctcatcgaggtggtgacgcccaccgccttctccgagtgcccgagcctcatcagcatcgacctgtcctccaaccgcctcagccgcctggacggtgccacctttgccagcctcgccagcctgatggtgtgtgagctggccggcaaccccttcaactgtgagtgcgacctcttcggcttcctggcctggctggtggtcttcaacaacgtcaccaagaactacgaccgcctgcagtgtgagtcgccgcgggagtttgccggctacccgctgctggtgccccggccctaccacagcctcaacgccatcaccgtactccaggccaagtgtcggaatggctcgctgcccgcccggcccgtgagccaccccacgccctactccaccgacgcccagagggagccagacgagaactcgggcttcaaccccgacgagatcctttcggtggagccgccggcctcgtccaccacggatgcgtcggcagggccagccatcaagctgcaccacgtcacgttcacctcggccaccctggtggtcatcatcccacacccctacagcaagatgtacatcctcgtgcagtacaacaacagctacttctccgacgtcatgaccctcaagaacaagaaggagatcgtgacgctggacaaactgcgggcgcacactgagtacaccttctgcgtgacctcgctgcgcaacagccgccgcttcaaccacacctgcctgaccttcaccacgcgggaccccgtccccggagacttggcgcccagcacctccaccaccacccactacatcatgaccatcctgggctgcctctttggcatggttatcgtgctgggagccgtgtactactgcctgcgcaagcggcgcatgcaggaggagaagcagaagtctgtcaacgtcaagaagaccatcctggagatgcgctacggggctgatgtggatgccggctccattgtgcacgccgcccagaagctgggcgagcctcccgtgctgcccgtatctcgcatggcctccatcccctccatgatcggggagaagctgcccaccgccaaggggttggaggccgggctggacacacccaaggtagccaccaaaggcaactatatcgaggtgcgcacaggcgccggcggggacggtctggctcggcccgaggatgacctcccggacctcgagaacggccagggctcggctgcagagatctccaccattgccaaggaggtggacaaggtcaaccagatcattaacaactgcatcgatgctctcaagctggactcggcctcttttctgggaggcggcagcagcagtggggaccccgagctggccttcgagtgccagtccctccctgcagctgctgccgcctcctcagccactggccccggggccctggagcggcccagcttcctttcgcctccctacaaggagagctcccaccacccactacagcgccagctgagcgccgacgcggccgtgacccgcaagacctgcagcgtgtcgtccagtggttccatcaagagcgccaaggtctttagcctggacgtgcccgaccatccggccgccacagggctggctaagggcgactccaagtacatcgagaagggcagccccctcaacagcccgctggaccggctcccgctggtgccggcgggcagcggcgggggcagcggcgggggcgggggcatccaccacctggaggtgaagccggcctaccactgcagcgagcaccggcacagctttcccgccctgtactacgaggagggtgccgacagcctgagccagcgcgtgtccttcctcaagccgctgacccgctccaagcgtgactccacctactcgcagctctcccccagacactactactcagggtactcctccagccccgagtactcatccgagagcacgcacaagatctgggagcgcttccggccctacaagaagcaccaccgggaggaggtgtacatggccgccggtcacgccctgcgcaagaaggtccagttcgccaaggacgaggatctgcatgacatccttgattactggaagggggtctccgcccagcagaagctgtga

SEQ ID NO: 481 - DNA, 822 bp, Homo sapiens
  CDS (9)..(458)
  misc_feature (1)...(822): n = a,t,c or g
gcctgggaatgaagccagcctgcctggggcggcccccgccgcgctcccccgggactccgggctgctgtgaggaaagcagcaactcgtggggtcctggtgaagagaaaacgacctggaccctgcaaagcgacccagaacaaagggagcccgccacccacgttatgaagacaaaacactttatgcaaaggggactggactcagaaaccaagaaacaactagaagaagaagaaaagaaaatcattagtgaagagcactggtacttggatttgccagagcttaaagagaaagagagtttcataatagaagagcagagtttcttactatgtgaagatcttctctatggaagaatgtcattcagaggatttaatcctgaggttgagaaattgatgcttcagatgaatgctaagcacaaagcagaagaagttgaagatgaaacagtagagcttgatgcagtcagatgaagagatggctagaagatatgagaccttggtggggacaattgggaaaaagtttgccagaaagagagaccatgccaattatgaagaagatgattaagatggatgccttaagcgatggcccaggggtgcttggtggaagtcagcagcgcatctggagctcatcccaatggtgtctctatagttattaatactgtaacgtttacttgtaaagagattatcattttagaaacatgctgtttttgaaacagatgtgtgatggatggtgatcatcctttgcttcttggtattcattcagagtggatttttagcccctgatctacaaatgtacgtttgtacagggctgctttctaagattnttttacct

SEQ ID NO: 482 - DNA, 495 bp, Homo sapiens
  CDS (56)..(262)
ctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcaggtgaggcccgcgggacgtgggggtgggggcgtcctcccagcagcgcaatgcccccctcgcgaggaaacccaggctagaccgcaggaaggtgcatttgggttccgggggttcagaacagtcagtgtctgggaggccgtaggtgtggggacattctcagccacttcattcactcatttattcgttcgttcatcccacaactacttggtgagcccctcctgtggaccaagtgcttttcaaggcaccggggacacagtggcgacaaaacggcgctccccgtgctgtgggactgactgtccagatgtggagg

SEQ ID NO: 483 - DNA, 2963 bp, Homo sapiens
  CDS (529)..(2757)
gagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaaaaaaaaa

SEQ ID NO: 484 - DNA, 3071 bp, Homo sapiens
  CDS (529)..(2865)
gagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaacttttaaaaaaaaaaaa

SEQ ID NO: 485 - DNA, 1082 bp, Homo sapiens
  CDS (419)..(646)
ggaggaggtgcggccccaaggggaggaggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggttggggaagcaaactggaacccatggcaataataggagggtgtccaggctgggcccctcccctggtcctcccagtgtttgctggataataaatggaactatggctctaaaaaaaaaaaa

SEQ ID NO: 486 - DNA, 2078 bp, Homo sapiens
  CDS (273)..(1814)
ggcacgaggctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgctggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaagatcaaggagttgttgaagaagctggagcagctttcagaagaggttctagcaattcggggagaaaatgctcgccttgccctgcagctgcaggattcccagaagaaccatgaagagatcatctccacctacaggaatcatctactgaatgctgctcggggttacatggaacatgaagtgtacaatatcctgctgcaaatccttagcatggaagaggagtgaggcagcctcactgtgtgccctcagggatacgagattctctgttggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacgggaaaaaaaaaaaa

SEQ ID NO: 487 - DNA, 445 bp, Homo sapiens
  CDS (91)..(261)
cccgacgatttcgagcgtggctgagattcctcatcgctgccggagcagaggcccaggctgttcatcccctacttcttcttccccaaggaaatgcccaaggataaacgtgagcttcagcttcggcgaaaggtcttagcagtcacagactcacctgccaggaagggcaaggactctccctctaagcagagccctggcgagtccacgaacaagccaggatggcctagtgcagattgcaccaaacctgactgggagccagttcattaaagccttccccagggtgctgctgcagaccctacgccaccccagcttcctgcccaagctcccggagcgccaggtttccatgacagactgctactccaacctgctcatcggctagctcgccttcccttcggtcatcgagagcatcgcggtgagcggcgccctgcacaagatgctctaccctgtc

SEQ ID NO: 488 - DNA, 1297 bp, Homo sapiens
  CDS (409)..(723)
gctgtctgcctccggctacggccactacctctcctgcggggccgagggagccgtgcagggtaagcggggccagcgaaatgtgcttggcccggaggactgactacggttggtctccccacgcgcgcgagggacggggttccccgtggtgcagttccaatgcctgatacctccctgggcccggagacagctccggggggaggcctcggggtcacttgcgctctcggtccattcaactggctgtctttccgaccctgctgcgtagccctcgcacgtctacaacacaccgtgggactcgtgagctatgctgtaggccaagcagcaggggtctctgcccgagtgtagcccacagccctgccgcgtccattcattctgctggcttgtgctgacccgcccccagcagactgagaaatgagaaaaataccaaaccatggcaccctgcggatgacgaaggtggcatatcccctgggactgtgcgtgggcctgttcatctatgttgcctatatcaagtggcaccgggcctctgctgcccaggccttcttcaccattgctggggctgcctcgggggcacggtggacccagcaggccttcagctccccaggctcagctgcacgtggtcatgaggtcttctatgggatcatgtttgacgctgggagcaccggcacccgcatccacgtcttccagttcgcccggccacctggaggtaacctgtctaactctgagccctgagttatgggcacagacacaggatctgccttccccactctcagggcaaggctcttgagaattcctgacttcagaagagagtgtgaggcttgagcccctgctccagagtaatgtagaagcctgctgacatgaaattattacggcactggggcaaagctcagtgggagaagcacgtgtaaggccctgggtgtgagtaccagaccacttgaaaaaagaagtacagttactaagagatactcagtggctacaaagcctgtgccgctagcctcccctggagcccaaggctcttcttacatgagtgagcagtgactaccattgatggggagataaggccctagagggcatttagtagcctgtcccctccctgtgtccacagtaggccttgtagctgaacctgtaatttgggccatgtcatgttgatattgggagatcgcaaggcagggaaataactcaagagtcaggctcagggaagccaggatcccaggcaaatcagaacagtagcagaaacctgggactgaggcttgcagatctgctgctgtaggtcctgcatggcactgagggctctggacctcag

SEQ ID NO: 489 - DNA, 6653 bp, Homo sapiens
  CDS (1)..(5844)
atggggaaatgtggcctctgtgtgaacatggtgatggatccaaagggcggcagctggggctgtcagtcacagtcttcccctcggcaagttcttcagaaggagccttttgagattgatggaagctctgtgcagctggtcagtctctcagccattactttggaaacaggaaacgcctcaagacatggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacaggtggtatataataaaactacacaaggatgttgtgggaaatgctgtaccagacagtacagtattctctcatccagacacaattttcctattgcagaaaagtattggtatgattctaatcagcatggaaaagatagacttggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaaaaaaaaaaaa

SEQ ID NO: 490 - DNA, 704 bp, Homo sapiens
  CDS (147)..(332)
ccccaataatacagcccctgatgtaactatcactaagggtctataaggcctcaccactctaggaaatgaactagctgaaaattcgggaatgaatgatccctttacaggtgtaatggaaaaaatggtttggtagatggaaaggactaatggcctctattctcacctcccttgtgatcataataggggtgctcattctcttagggtgctgtattataccctgtgtctgcggactagttcaaaagctcatagaaacagcccttaccaagacctcccacaactctcccccaccctattcagataaacgtttatttctaagcaaccaagaagagcagtgaagccagatcctgttagaaatatatgaagaggaaggactacaaaatcaaaaggggaaaattattagacaaaatgagttgctctacaaaggtccaacttcgttgtcctttgttctgtaacctttgttctgtaaactgcccttcccgcagaaactgtctttcccgccgaccaaaactgcccttcactatcactgtaatccatacccctactctatttgaaactgccaatcgggatcagcttacattgtgtggttcaaccaccagccaatgaggaaaaaacacagaagcaaaagctatgatgcattagggttaaaaaccccttcctttccctgtccaatgtgctcttgagactgctacaggcgcaagcagcca

SEQ ID NO: 491 - DNA, 954 bp, Homo sapiens
  CDS (55)..(471)
agacttcggctcggttcccgagacggaatacccaggagtcgagtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagatttggtctcaataacggaaccgggtccctttagaaatgaatggttttagagtggtttaacttacaagatgagctaatttctgtgcgcgaaaatgaggtttgattcacaccaactttggtgggtttcgagtccggggtctgagccgggcaggccatcgttggtccctttattccttgggggctcgaaaaagggc

SEQ ID NO: 492 - DNA, 1515 bp, Homo sapiens
  CDS (212)..(1216)
ctctcgacgcgaacattcggcacgaggtgcgatttcctgtaccagtactggaagttgaagaggaaggtcaacttcaactaagcccctgatcaccccaaagaaagatgaagaggacaatctagccaagcgggacgaggatgtcttatttaggaggctgcagctgttcacgcacctgcggcaggacctggagagggttcggaacctcacttacatggtgacccgcagggaaaagattaaacggtctgtgtgcaaagtccaggaacagatattcaatctttacactaagcttttggagcaagaaagagtttcaggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaaaaaaaaaaa

SEQ ID NO: 493 - DNA, 2105 bp, Homo sapiens
  CDS (248)..(1144)
cgcggtcgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgtaaaaaaaaaaaaaa

SEQ ID NO: 494 - DNA, 840 bp, Homo sapiens
  CDS (498)..(746)
cccttcttttaaaactctctctcttctcagcttgatacccacctttcactttttcactactttgaatgcttttttctttgtaccccttgaaattgaattaaaaattagatttgcaaatgtataggaagattaagaacatctttgaggtgcaggaataaagttgtaagtgcctggactcgagtgatagcactgaaaaggaatcacctgacattttgaatagagcttatacagtagatataataaaaattgtattttgtcatgggctgtaaggaatggtggatataatgtcaatgatcactaagttttagaggatttgaaaggaagaatagtagaatgttttcaaaattaggaagtcagttgggaaagaaccagttttgttcattaggaatggaagtgatactttttttctggtatcaaaacaatcttgactttttctccttctcttagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattactgtgctctggaacagtttactaccatgaatctatcctatgtcttcattcctttatgggccttgctggctggggctttaacagaactcggatattgtcttttttgtgagagactgcttct

SEQ ID NO: 495 - DNA, 5023 bp, Homo sapiens
  CDS (149)..(4426)
agagcagtgcgagcggtcacgtgggccggcggtccagggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttgttcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttgatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattatgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctcaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgcccttccatcaatcttgcaaagaatcttacaggatccagtttatggaaaaggaaaacttggagaaatccagggacttatcttgggaatgttagatacctttaactatgaacaaaccctgctggaaacaacaaccagccttctaaaccaagatctccattggtcattgtgtaacctgagagcttcggtcaccagaggactgaatcccaaacaagattactgctctatatgtttgcagcagtacaagagacgccaagaaatggctgatgaaataattgtctttagctgtggccatttgtatcactcattctgcctacaaaacaaagaatgcactgtggaatttgagggccaaacaagatggacatgctacaaatgcagttcaagtaacaaagtaggaaaactcagtgaaaattcatctgaaattaaaaagggaaggataaccccatcacaggtaaaaatgtctccatcgtatcatcagtccaaaggggatcccactgctaaaaagggaacctcagaacctgttctggatccacagcaaatccaagcatttgatcagctttgccgtctctaccgaggaagctccaggctggctctcctcacggaactctcccagaatcgcagcagcgagagctataggccattcagtggctcgcagagtgctcctgctttcaacagcatcttccagaatgagaacttccagctgcagctcattcctccacctgtgactgaggattgatgactccatggagcctggcccaggagaaccagagatgatcccgaggcagctggggagaggccccgcctctggtgggcttggcctccaccacctcccatgcttctgagaagaggttccaaattgggcttctgtgcccagagcgtccacagcaccattcccagtgtagactcccagtcttctccacattgctgtcatggcgtcagttcaccagactcattgattttgttttgcttgttaagcaaaggaatgtcacatacctctgtccagctttttaggaaatacatttcgcctattgcgactttttccatttaccctgaagcctagaaagtaggtggaactcacacaaatggcattccagagtctgccatactccgtctcctccagctgctggataatacagaggaacttcaacttctacagggaacagtggttggccaggctgcagtataactgaagcatgccttggagagagcagacactgtgggggccagggccatctccctttaatgtgttcatgttaaaacctatttgagtgtaagacttgccctttctaacaataaatgctctgtgtttaagttcaaaaaaaaaaaaaaa

SEQ ID NO: 496 - DNA, 977 bp, Homo sapiens
  CDS (192)..(881)
tttaataagaccgtggaattctcgactcgaatagggagagggataccgagcgcgtccgtagtggcggctggcgctagggaactgcagggtctagggtgttgtcggagtggcagttggtccgaatttctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaaaaaaaaaaaaaaa

SEQ ID NO: 497 - DNA, 1776 bp, Homo sapiens
  CDS (261)..(1088)
catccatcatggcgtctacagccgcatgggcgtgcgtccctctgtttatatggccagagccccgcctcgctccgcccctttaaacttggtgggcggaccgaggcggggctcagaccaggccccaccccgatcagccacgtccatcgccctgatttccaggccctcccagtccctgggcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctttccttggggtgagggacagagccccacgctgttgacatcagcctgctttttcccctttgcggctttcactgctgagtttctgttctccctgggaagcctgtgccagcacctttgagccttggcccacactgaggcttaggcctttttgcctgggatgggctcccaccctcccctgaggatggcctggattcacgccctcttgtttccttttgggctcaaagcccttcctacctctggtgatggtttccacaggaacaacagcatctttccccaaaatgggtggccccaaccctgctgggacttggatcccaggggcttatctcttcaagtgtggaaagggcagggtccacgcctttgctgtagcttatgaaattaactaattgaaaattcaaaaaaaaaaaaaaaaaa

SEQ ID NO: 498 - DNA, 2906 bp, Homo sapiens
  CDS (321)..(1898)
agtactacgagccacagctgtgcctctcctgcctcacgggcattacggctgccgttggaagcgctaccagcgctcccatgatgataccacaccggatagcgtctgggcctgcacactccaggacctgactcagaggaggtcctcggacaagatttactgaatgaacaactggaaggaggattgagcatatgtgttcatgatgggagcgcctctggttcctgctcctcaccttcacctttggcctcacgctcacctggctttacttctggtgggaagtccacaatgactatgatgaattcaactggtacctctacaaccgcatgggctactggagcgactggcccgtacccatccttgtgaccacagctgctgccttcgcatacatcgctggcctcctggtcctggcactatgtcacattgccgtggggcagcagatgaacctgcactggctgcacaagatcgggctggtggtcatcctggcttccacggtggtggccatgtcggccgtggcccagctgtgggaggacgagtgggaggtgctgctgatctccctgcagggcacagcgccattcctgcatgtgggggctgtggcagcagtcaccatgctctcctggatcgtggcaggacagttcgcccgtgcagagcggacctcctcccaggtgaccattctctgtaccttcttcaccgtggtgtttgccctctacctggcccctctcaccatctcctctccctgcatcatggagaagaaagacctcggccccaagcctgctctcattggccaccgcggggcccccatgctggctccagagcacacgctcatgtccttccggaaggccctcgagcagaagctgtacgggctccaggctgacattaccatcagcctggacggcgtgcccttcctcatgcatgacaccaccctgcggcgcaccaccaacgtggaggaggagttcccggagctggcccgcaggcctgcctccatgcttaactggaccaccctgcagagactcaacgctggccagtggttcctgaagactgaccccttctggacagccagctccctgtcaccctccgaccacagagaggcccagaaccagtccatctgcagcctggcagagctcctggagctggccaagggcaatgccacactgctgctcaacctgcgtgacccgccccgggagcacccctaccgcagcagttttatcaacgtgactctggaggccgtgctgcactccggcttcccccagcaccaggtcatgtggctgcctagcaggcagaggcccctggtgcggaaggtggctcccggcttccaacagacatcaggctccaaggaggcagtcgccagcctgcggagaggccacatccagcggctgaacctgcgctacactcaggtgtcccgccaggagctcagggactacgcgtcctggaacctgagtgtgaacctctacacagtcaacgcaccgtggctcttctccctgctgtggtgtgcgggggtcccatccgtcacctctgacaactcccacaccctgtcccaggtgccttcccccctctggatcatgcccccggacgagtactgtctcatgtgggtcactgccgacctggtctccttcaccctcatcgtgggcatcttcgtgctccagaagtggcgcctgggtggcatacggagctacaaccctgagcagatcatgctgagtgctgcggtgcgccggaccagccgggacgtcagcatcatgaaggagaagcttattttctcagagatcagcgatggtgtagaggtctccgatgtgctctccgtatgttcagacaacagttatgacacatatgccaacagcaccgccacccctgtgggcccccgagggggtggcagccacaccaagaccctcatagagcggagtgggcgttagctgaagacatgtctgtcccacctgtacctgacacagaagctggggagcctaggagagctggtggaagtgtgtctgaactcggagtgctctgggagcgggctccacagcctccttgtgggctccagccccttgtcagccgcagcctctcttgagggggactccctgtcccctgaggcccagctgggccaggactccatcctttcagatgcccctgcaggcctggggctccttctgggaagtatggggcctagggcttggtccccctcttctgaggccctctcctgtatcccgacctggaagctttgatgggtcatgggccatgccataccccctgtggcaatggagtgtgtggatgctcacctgtgccatctgtcctcctgtctgtgccaggaggcacctgagttctctgctgttatcctgccccaagggcctgggccgagcctctacctgaagcaactctgctcttcctgtcagtctcaaagcacaaggaggttcagcccaggaggaagccagctgcaatgtggagacacgtcctcctccccaacccacctcatgccaccgccaaccccctgccccaggagcgggcctgagccacgtcccctaggagcagctggagatggccaaaagagtgagctcaggactactggatcccatgcccaggtgtccagcagacctcaaggcagaagggtcacctaacccaggagtccacagactgatgtgacctcaggttcccacatcagtggccacagggcagggcccacctggtagaagtgttctggatatggccagggtgggtgtgtggctaagtgggcctgaacagagggaacctagggcccttggccaatgtgataaatgtctttaaaaataaacaacataacctgccccttacgcctgtcattcagcctggcaggtccttagtgggctagacctacctttctgatgagctgcccgcccccagcgcaagatgattgtttgagaggtaaaaactcttgccaaaaacaacgt

SEQ ID NO: 499 - DNA, 1389 bp, Homo sapiens
  CDS (1)..(639)
atggcggcggcggcggctgcaggcgaggcgcgccgggtgctggtgtacggcggcaggggcgctctgggttctcgatgcgtgcaggcttttcgggcccgcaactgggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgtcaatctgtgttaactgcatagggaggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactccatggactctgtcctggtatccttttcctgtgtggttgccctgtgtcctctggcctagggttaagtgtgcaagataactactcgtgagtattcagaatgttgttcctaataaatgcacttgttgtctgtcttctttaatcaaatcacatcttacatacagcagtcagagatgagtatactagaatcatggattgctggaggtcttttaatctggtgttctcggaagggggtggatttaaatcctgaaataaatatttcaacacaagaaaaaaaaaaaaaa

SEQ ID NO: 500 - DNA, 2791 bp, Homo sapiens
  CDS (550)..(984)
tttcgttgagagaggatacttcctactgtggaaggggagaaaagaaaaaagcaaagctcactgtcctatgtcacctgtcctgagacattcctagaaggaagaccaacagacagcattcttgagctattccaaagagatcacagaggccaccaccaaagagaagactaagaatctaccatagtttgccccgagaggaagtccctgtaccctgtggaggaagagaggccttgatggagagaacccagaggccaaaggccagcaccacctgcttggcattaactacttcttggaagagcagtggagagaaaaatattgtttctttttcttgggaaattggcagaggcatgctgaagaaatcagctacagctgttctccacacctggataaatttttaataagaacttaacacacccgccctccagaaagggtggtctgaggtgtcgatggtgttgtctctcccagggctcttctgggcagccttctctgtgacctggagagcgaagagtctatttccatcacatttcagctgcccaaactcccctttaaacgatggatgaaaattataacctcttgcctcacggagtcaatttccaagatgccatcttcccagacactcaagagaacagaaggatgttttctagccttttccagttttcaaactgttcgcaagggcagcagctggcgactttctccagtgactgggaaatccaggaagacagtaggctcatgtgctcctcggtgcagaaggccttgtttgaggaggaggaccacgtcaagaaactgcagcagaaagtggccaccctggagaagcgcaaccggcagctccgggagcgagtgaagaaggtcaagaggtccttgcggcaggcgcgtaagaagggccgccacctggagctggcgaaccagaaactcagtgagaagctggcggcgggcgcgctgccgcacatcaacgcccgggggcccgtgcgccccccctacctgcgggggtaacgggcctgggggctgccaggtgtgcagggccaatcctggcggtaattgagaatgagtgaggtttcgtacatgcagctatttcaagggttgtaagagtttttttttttaatcacgcatttggtagagtctaaatggataaaatgcaaggcttgctttccccttgggtgctggcctcaatgtcagaccccacgcgctgccccttcctggcctgaccccagacgcagtgcctggcagtccagaggcagtgggatccctgagtgctgaatgctcgcctgcagagcagcccagaaagagccctgactggggagagaacattttagaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagacccccccagacactgcagggcctggtgatgctgtcctctgtaccggaaatggcaggcactgtcagatttccactcttctgcctttaggaaggctgggtgcttcttgctctgacagccagtctggggagatgactcttacgttgcttgagtcttggtggcaggctgctgtccacgggggagaagtctctgctctggactggacagaagagagacttttaccctggggcactcacacggccaagcttctgccaccacttcattagctgtattctccatagtatggtgaaatagcaggtgcgtcttctagtttattcctcctggggacatttcctcaaagcagttttgcgcccccgcaagggaatggtcagcctaagggtaatgtacagcccgtgcttggagaaccatggaagctacacccctacaggtgcatactgttctgcttttccaataaatacgagcggcgatttcaaccacaaaaaaaaaaaaaaaa

SEQ ID NO: 501 - DNA, 1120 bp, Homo sapiens
  CDS (396)..(995)
ggacactttgagttacttataatagtgtatactataagatataaagcagtcataattacctaagcttcaaaaatcttttgtttccatgtccagagacaagtacagtacagtattcttatttgtttgctccccctttttaaaatatttaatagcttatgttcacttctcatagctcctttctttatgaaaaataacatgaaaatagaaaagttgttctaagtatactttttgtatatattctagacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccagtgtgaagagtgcttgtgttggcaacacagcgtgtgcatggggctgctggaggagagcattccagagcagtacatctgctatatctgccgggacccaccaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaaaaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgaagaagtgtaatgatagttgggaggagagaccaagaattcacacatgagaagtaaaaaacagtttacagtactcagcaaaagaacatggaatgcctgaaaagaatccagctgaagggcatacagtatttgttt

SEQ ID NO: 502 - DNA, 683 bp, Homo sapiens
  CDS (487)..(645)
ctaaagataactgcattgtaatttatagaatgcatagaagggagataaggaaatcaggaggccatgaaatcccagtgagccaagcctccgtcacccaccatgtaaagcacggaggcagcttgaaaagacattgagagaagtaaacccacaggttcagtggccagtggcaaaggacaagagccacagaggcactgggacctgaaagctaagagagcagggatgcgggtcacagagggagggatgtttggggctacaggtggatagaaaggaagatggagttgagtttttgacctgttgacttaccgtagtggtaggatacctggtgaggcttgtggcctgcattgggcattctgggtcacaactctgaatgaggttggagcagaggtccagctgtggtgaggattggcacagtcgtgcttgtgggactcctccttggtccaactctaatgctcaacctacaccatcacccctgtgcttgctcctctaatgcctaagcactgtcattcctttatcactagtagttgcctgttgggtttgctccatttgtcctcacagtttagctgccctggaaggaaactccaccctgttcagagacacactgaggctgagacccaagggaggcccctctctgattggacagcctcttgatagaactggggaagctccctcaacagccatcaggt

SEQ ID NO: 503 - DNA, 1503 bp, Homo sapiens
  CDS (998)..(1261)
gtatcagctgatcaattttaaaatgccttagactggggatatattagaggaagcagattgtcaaattaagggtgtcattgtgttgtgctaaacgctgggagggtacaagttggtcattcctaaatctgtgtgtgagaaatggcaggtctagtatgggcattgtgattgcattgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtatccaggacgctaccatttaaagtttgcagatgagctcatggagggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggccgtgagcagggtcctagccgcgagcctcaccccacttaacatatcctgcggggaggaggagccccaggggtgctagtctggactgctgggactcgcgccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaaaaaaaaaaaaaa

SEQ ID NO: 504 - DNA, 1329 bp, Homo sapiens
  CDS (13)..(981)
gcggcttttggcatggcgactttttctggcccggctgggccaatcctgtcgcttaatccgcaggaagatgtcaagtttcaaaaggaggtggcgcaggttcgcaagcgcataacccagggtctcccaagtggattcgaccgaatcagggaccgacctcttaagcttgcaggccacggtttccgagacgaaagggtttacgctgttcgcgaaaaaaacctggaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgaacaactacctgtttggtgaaagactcttggagtgtcattttatgccacctgaaaaagtacataaagaactctttaaagactggaatattccatttaagcagccatcatatccatcagtgaaacggtataatcggaatcggacactaacacaaaagctacggatggaggagcgatttaaaaagaaagaaagattactcaggaagaaattagctaaaaaaggaattgactatgattttccttctttgattttacagaaaacggaaagtatttcaaaaactaatcgtcagacgtctacaaaaggccaggttttacgtaagaagaagaaaaaagtttcaggtactcttgacactcctgagaagactgtggatagccagggccccacaccagtttgtacaccaacatttttggagaggcgaaaatctcaagtggctgaactgaatgatgatgataaagatgatgaaatagttttcaaacagcccatatcctgtgtaaaagaagaaatacaagagactcaaacacctacacattcacggaaaaaaagacgaagaagcagcaatcagtgattttcaatgtattatatttcttttgaaaaatataatatttttatgagagtggactttgtatttcactaggtacaatggaatacaacctttgacaagattttcagaggaaaaatacactgtttggtcaagttaagcgcaaagccggtgtaatttggatggctgccttgggtgaaatacaggcgtgctacatctgcagggtggtgaattgcttttgcggcctaggttcttgaaattcaaaggctcctagtaactgccgaaaaaatggccacggcggtactaagggctttgggcaaaaaccaccgtgccccacggggggcaccgggggcaccggggggttatggggcc

SEQ ID NO: 505 - DNA, 2175 bp, Homo sapiens
  CDS (569)..(1864)
tttcgtgaggccctaagatcccagaggatgccataagaggaaaagtcaggggagtgttgaagactctgcctcctacaaatatgattgttggagtacaaaatgacagtatgagcaagtgaaatggtatgcctagtaccagtgagagccctcagtaaacagtaggcagcaaccaagctggtgggaagcctcctatccaggaggatgcaaattgttgacttgcaagatgatgaggatttccagatagacacagtctattcctgcagtgatggtgtcataccagcccatggaacagtgcccatcaaacaagatgccaccggaaatgtcatcttctccccagacgctggcttgcaagcacagcagcacccagaggctaacctatttcccctatagcccaagctctgagatctcccgtctggtcacaatgatctacaggagaggaagaaagctatctagggacgagatctagaatcaactgagagagatgcttaaaaatcaccagttactttaatgaccatccgcagagccatcctgtgcaaaggaaggagctaggctgtgcgccctgggcgtcatgatccttctgcgggcctccgaagtgcggcagctgcttcacaataagttcgtggtcatcctgggggactctgtgcatagggcagtatacaaggacctggtgcttctgctgcagaaggaccgcctgctcactcccgggcagcttagagcaaggggggagctgaacttcgaacaagatgagctggtggacggaggccagcggggccacatgcacaacggccttaactaccgtgaggtccgcgagttccgctccgaccaccatctggtgcgtttttacttcctcacccgcgtgtactccgattacctccagaccatcttgaaagagctgcagtcgggcgagcacgcccccgacctggtcatcatgaattcctgcctctgggacatctccaggtatggtccgaactcctggagaagctacctggagaacctggagaacctgttccagtgcctgggccaggtgctgcccgagtcttgcctcctggtgtggaacacggccatgcctgtgggcgaggaagtcaccgggggttttcttccgcccaagctccggcggcagaaggccaccttcctgaaaaacgaagtggtcaaagccaacttccacagcgccaccgaggcacgtaaacataacttcgatgtactggacttgcatttccacttccgccacgcgagggagaacctgcactgggacggggtgcactggaatggacgtgtgcaccgctgcctctcccagctgctgctggcccacgtggccgacgcctggggtgtggagctgccccaccgccaccccgtgggcgagtggatcaagaagaaaaaacctggcccgagagtcgaagggccgccccaggccaacagaaatcacccggccttacctctgtccccacccttaccttcccccacataccgccccctgcttgggttcccaccccagcgcttgccgctgctcccgctcctgtccccacagcctcctcctcccattctccatcaccagggaatgccccggttcccacagggtcccccagatgcctgtttttcctcagaccatactttccagtcggatcaattctattgccattcagatgtcccctcatcagcccatgcaggtttcttcgtcgaagacaattttatggttggtcctcagctgcctatgcccttcttccccacaccccgttatcagcggcctgccccagtggtacataggggttttggcaggtatcgtccccgtggcccctatacgccctggggacagcggcctcgaccttcaaagagaagggccccagccaatcctgagccaaggcctcaatagacggacctaggccttatttcctctttatgaacatggattggacagatctgacacttcctttccattgcttggcctgaacagactgaccttgttaacttaagcctggagtccatgcctcgtcttccttttgttcattgctgttaccaagaaagccaaggaagagcagcctgactcattcttcttggctgcagcctcttccccacttcctgggagtgacccagcgttattcctgcctcctcactcctattctctttgcctttgtgtaaaaataaaatggaaataaacaagttgcacagaaaaaaaaaaaa

SEQ ID NO: 506 - DNA, 2525 bp, Homo sapiens
  CDS (507)..(2522)
agcagctcagcaggataataagcttactcgcctgaccttgggtctctctctcatcctttctcttggctaaccttcattttggtgccaaaacccaggaaggggataggctctggctgggcgtccttagaggattctctctctctctctcctatcatcccttacccagccaacctccccttcccgaacctgctaaagaccctaaggatctcccaaaattctcccattgttggccacctcatccaccatcaaagcctctgagaggggtgagtaagagagacttttgcctattacctggaacccttgaccatctcttcactcccaaaagacccagcgctgggccaagggcttcctctggcctccaggcctctggttcctctgtttcctggacgcctgactccgcagctacctcctctattccatacaaggcctgcaagacaggcgccgccctctctcgtctttgtcgtctgtggtcccttcttcctctaccctcacctcctccattcactatgggagcctctcagtctacccctcccaagaccaccccccttgggtgtctcctccgcaatcgcaaggctctcggcctccgttcagggatccgttctaagaggcttatcttttactgcaatactgcatggcctcaataccaattggacaatggctcccaatggcccgaaaatggcactttcgatttcaatatacttagagacttagacaacttttgccatcgcaatgagaaatggtctgagattccttatattcaggctttcttcattctccgtaaccacccttctctctgccactcctgctctactttccaaatcctactcaccagctcaaaacctgactcatctcccgtcaccccacccacagacccagccgatgactcctcttcctttgaccccgtggattttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacagattgaagaacgtctcgggtccttctcctccgatcctgatacttacatcaaagaatttaaatatcttactcaatcttatgaactcacttggcatgatctctactttatcctctcttctaccctccttccagaagagaaggaaagagtgtggctcgcagcacaggcatatgccgatgaccttcatcagcaggatcctactaagcccgtaggagctgctgctgttccctgggaagagccttcctgggaataccaacccacagaccctggccaaagtcccctcctgctcctctccgctagtccggcccctgacccctttccccagtacccacttcctgcctctctcattaacccttccgtagctgctcaccatgaccccatcagaatccagttaaaagactcttccaaatttcccaatgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccgagccatcagtcaagctgtcctccctattcatcccatagtccataacccctatccacttctctctctcgtcgctaccaacaccaccctctacactgcaattgacctgaaggatgccttctttaccatttccctacaccctgattcccaaaacctatttgctttcacctggactgaccctgacaccctccagtcacaacaactcacatggactgtcctccctcagggcttcagggatagccctcatttctttggacaagctctagcccgaaaccttacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctga

SEQ ID NO: 507 - DNA, 1715 bp, Homo sapiens
  CDS (62)..(493)
cacgccatgtttggcacgagggtgacgtccctgcgcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcgggcaccggggccgtggggctcatggctgctaccctcggggctgatgttgtagtcaccgatcttgaggaattgcaagacttgctgaagatgaatattaatatgaacaagcatcttgtcactggttctgttcaagccaaggggggaagaaatagaaggctttccttctccacccgacttcatactgatggccgactgcatatactatgaagagtctttggagccattgctgaaaactctaaaagatatcagcggatttgaaacttgtattatatgttgttatgaacaacgaacaatggggaaaaatccagaaattgagaaaaaatattttgagaaatttccatcgtgaagcctttaatcatcttacccaaggctctaacaacctgggtaaactaaagatgtgaatagagcatgtgaatacagcatgggaagattgtgttcacagatttttttttccggcacgtccttagagatccgatgtatagatgatgaccaccaggggctgtctgcaatacgaaaaattcctgcttgcctgcctgcctgccaatggccctgaatccagcttaggttacttagttcagcatcaagttcttcttaaatgttgggaatcagttattcaaataaaaattggtattgaggcgaggctgaaatctgccaaaaacagccaacatgatttgactggaccttttacaggaagctagagataaatttctgaagagaactatctgctattatataataatgttttaaattcaaactagtaaattttagtttgtcttcagagtttaaaaggttttcattttgtacataattatacaatatttatcatttgtattttccacttcatttcttttaaaatatctttaatactgaaatgttcttttaattttaaaaagaactgagatattgtcttgtatacttatattggccaaagttttcttttcctccaccatacatatctatgtgatttaatcagtaaattgtactgtaatgagttgctaagaagacaaatcagaagattggaggaacaaaagatatctttacagatttttcatttgagcatggagtgagaatagaaagaccagtttcaggcttatgcacttacgtggctcatgcactttatgtatatgttccaggaaaatctggcttaaaaatactggtattgtttacatgaagcagtgaaaggtttttgaataactacaaatgtagttctatatgtatataccaaatgaatttctgttctgtgtctctctgttttatgttatgaagccattcgctcatatacaataatctgtcaaggactttaatcatacttgttccaaagagtagtaaccggatggaattctggtatttacaggcattggtgctagatggtacattttatgtgttaaaataaacattgtttttgagaccttgaaaaaaaaaaaaa

SEQ ID NO: 508 - DNA, 1116 bp, Homo sapiens
  CDS (217)..(1002)
gcacgggtggattccagcccccagccccagggctctgaatcgctgccagctcagccccctgcccagcctgccccacagcctgagccccagcaggccagagagcccagtcctgaggtgagctgctgtggcctgtggccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcggtgcccgccggggtcacgtgctcgccaaggagctcgaggcgttcagggaggccaaacgtcaccgtcccctgattgctctacccacccaagagccccgcccacgggggcggcccccccagagaagagtggccacgcacaatcggagaagtggaggccaaacactgcctgcaaaagttctggcaagccgcggcggccaaccattctctgcagcctcctcctgaaccaacggagcgtttccactcacgggtccactcccggaaatgcttctcgggttccaccgtgccccctggggctttctcctgagcccacgttccccgtgcccacagccttcccgagaaccacggctaacttttctcggccccctccatcgggctgaggaagcacagcagcattttcaaacaagtaccaaatcgattggctttaaacacccttcacataccctcccccccaattatcccccattatccccacacataaaaaaaaaaaa

SEQ ID NO: 509 - DNA, 1697 bp, Homo sapiens
  CDS (252)..(1334)
ggcaggtcagtcaggtacctgggcgctctgttacacaagcaagatacagccagccccacctaattttgtttccctggcaccctcctgctcagtgcgacattgtcacacttaacccatctgttttctctaatgcacgacagattcctttcagacaggacaactgtgatatttcagttcctgattgtaaatacctcctaagcctgaagcttctgttactagccattgtgagcttcagtttcttcatctgcaaaatgggcataatacaatctattcttgccacatcaagggattgttattcctttaaaaaaaaaccaataccaaagaagcctacaatgttggccttagccaaaattctgttgatttcaacgttgttttattcacttctatcggggagccatggaaaagaaaatcaagacataaacacaacacagaacattgcagaagtttttaaaacaatggaaaataaacctatttctttggaaagtgaagcaaacttaaactcagataaagaaaatataaccacctcaaatctcaaggcgagtcattcccctcctttgaatctacccaacaacagccacggaataacagatttctccagtaactcgtcagcagagcattctttgggcagtctaaaacccacatctaccatttccacaagccctcccttgatccatagctttgtttctaaagtgccttggaatgcacctatagcagatgaagatcttttgcccatctcagcacatcccaatgctacacctgctctgtcttcagaaaacttcacttggtctttggtcaatgacaccgtgaaaactcctgataacagttccattacagttagcatcctctcttcagaaccaacttctccatctgtgacccccttgatagtggaaccaagtggatggcttaccacaaacagtgatagcttcactgggtttaccccttatcaagaaaaaacaactctacagcctaccttaaaattcaccaataattcaaaactctttccaaatacgtcagatccccaaaaagaaaatagaaatacaggaatagtattcggggccattttaggtgctattctgggtgtctcattgcttactcttgtgggctacttgttgtgtggaaaaaggaaaacggattcattttcccatcggcgactttatgacgacagaaatgaaccagttctgcgattagacaatgcaccggaaccttatgatgtgagttttgggaattctagctactacaatccaactttgaatgattcagccatgccagaaagtgaagaaaatgcacgtgatggcattcctatggatgacatacctccacttcgtacttctgtatagaactaacagcaaaaaggcgttaaacagcaagtgtcatctacatcctagccttttgacaaattcatctttcaaaaggttacacaaaattactgtcacgtggattttgtcaaggagaatcataaaagcaggagaccagtagcagaaatgtagacaggatgtatcatccaaaggttttctttcttacaatttttggccatcctgaggcatttactaagtagccttaatttgtattttagtagtattttcttagtagaaaatatttgtggaatcagataaaactaaaagatttcaccattacagccctgcctcataactaaataataaaaattattccaccaaaaaattctaaaaaaaaaaaaa

SEQ ID NO: 510 - DNA, 1260 bp, Homo sapiens
  CDS (190)..(585)
aaggatccttaattaaattaatccccccccccccccggtggcccctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaaatagggtatttgtttcatgtgttgccattaataagcagaaaattaagtgctgtatgggttccatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaaaaaaaaaaaa

SEQ ID NO: 511 - DNA, 3063 bp, Homo sapiens
  CDS (17)..(2041)
gttttcatagataaccatgacaacatcccatatgaatgggcatgttacagaggaatcagacagcgaagtaaaaaatgttgatcttgcatcaccagaggaacatcagaagcaccgagagatggctgttgactgccctggagatttgggcaccaggatgatgccaatacgtcgaagtgcacagttggagcgtattcggcaacaacaggaggacatgaggcgtaggagagaggaagaagggaaaaagcaagaacttgaccttaattcttccatgagacttaagaaactagcccaaattcctccaaagaccggaatagataaccctatgtttgatacagaggaaggaattgtcttagaaagtcctcattatgctgtgaaaatattagaaatagaagacttgttttcttcacttaaacatatccaacatactttggtagattatcagagccaggaggatatttcactgcttttacaacttgttcaaaataaggatttccagaatgcatttaagatacacaatgccatcacagtacacatgaacaaggccagtcctccatttcctcttatctccaacgcacaagatcttgctcaagaggtacaaactgttttgaagccagttcatcataaggaaggacaagaactaactgctttgctgaatactccacatattcaggcacttttactggcccacgataaggttgctgagcaggaaatgcagctagagcccattacagatgagagagtttatgaaagtattggccagtatggaggagaaactgtaaaaatagttcgtatagaaaaggctcgtgatattccgttgggtgctacagttcgtaatgaaatggactctgtcatcattagccggatagtaaaagggggtgctgcagagaaaagtggtctgttgcatgaaggagatgaagttctagagattaatggcattgaaattcgggggaaagatgtcaatgaggtttttgacttgttgtctgatatgcatggtactttgacttttgtcctgattcccagtcaacagatcaagccgcctcctgccaaggaaacagtaatccatgtaaaagctcattttgactatgacccctcagatgacccttatgttccatgtcgagagttaggtctgtcttttcaaaaaggtgatatacttcatgtgatcagtcaagaagatccaaactggtggcaggcctacagggaaggggacgaagataatcaacctctagccgggcttgttccagggaaaagctttcagcagcaaagggaagccatgaaacaaaccatagaagaagataaggagccagaaaaatcaggaaaactgtggtgtgcaaagaagaataaaaagaagaggaaaaaggttttatataatgccataaaaattgatgattatgacaacgaggagatcttaacctatgaggaaatgtcactttatcatcagccagcaaataggaagagacctatcatcttgattggtccacagaactgtggccagaatgaattgcgtcagaggctcatgaacaaagaaaaggaccgctttgcatctgcagttcctcatacaacccggagtaggcgagaccaagaagtagccggtagagattaccactttgtttcgcggcaagcattcgaggcagacatagcagctggaaagttcattgagcatggtgaatttgagaagaatttgtatggaactagcatagattctgtacggcaagtgatcaactctggcaaaatatgtcttttaagtcttcgtacacagtcattgaagactctccggaattcagatttgaaaccatatattatcttcattgcacccccttcacaagaaagacttcgggcattattggccaaagaaggcaagaatccaaagcctgaagagttgagagaaatcattgagaagacaagagagatggagcagaacaatggccactactttgatacggcaattgtgaattccgatcttgataaagcctatcaggaattgcttaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggttcttgcctcattttgggattctaaatggaagctttcaacagagcattccattttgtcctgttaaaaccttttgttttcacctaaaccctttctgcttagttgtatctctgtgaaaaacttgtatacacaagcgtccatgtctcacacaaatattgatgtgattattcttaagtgttaaatcattaacacttaaatgacttcattgggaatattgagcagagggactgtgcttctatgcactgggcaaggcagtatttgcttaggaaactaatttagtcatcagagatactttcctaaaaaggaaaaataaaaaacaaaatggtgccactttgggttgaagctactttgttaggcttgaattcatttatatgtcttttgattcttaaaaaaacaaaaaacattccattagaagcaccagtttttttgctcagactttgtggatcagactctacactcaacacactctaatctacttaaaggtatacaaaatatgctgatcttttttaaattatgatttcctgaatttttttcttaagtcgtctcaactgatttactcacttagcttcccttccctcatcagcatagtataatagaatgtatgttacatttttatgaatggcaggtgttcattataatctgtattgacttaaaaagtttcttcctcatgatgctaatagttttttgtatacatgggaggatagcacatttgacagtttttgcatttttatgtatgagcacagtatcctatgactgtgctacgtatatataggtaataaactggaattctgttgatgaaaaaaaaaaaaa

SEQ ID NO: 512 - DNA, 2382 bp, Homo sapiens
  CDS (78)..(2342)
caggctaggtagcgaggctgggtggttagtctttgggcgaagtgctgcattggtaagaagtgcttgataaagatgacatggtatacatggaagcatatgataacatgttggagtcctggttaactttggttcaagatgacaaacatttccataaaggcttttttacccaacatgcagttcaagttttcaattcctatattcagtgccacctagctgctccagatggcacaagaaatttgactgccaatggtgtggcctctcgtgaggaggaagaaataagtgaacttcaagaggatgatcgagaccagttttctgatcaactggccagtgtaggaatgctaggaagaattgctgcagaacactgtatacctcttctgacaagtttattagaagaaagagtaacaagactccatggtcagttacaacgacatcagcaacagttacttgcttcaccgggttcaagcactgttgacaacaaaatgcttgatgatctctatgaagatattcactggcttattttagttacaggctacctcttagctgatgatactcagggagagactccgctaatacctccagaaataatggaatattccattaagcattcatctgaagttgacattaatacaacacttcaaattttgggatctccaggagaaaaggcttcttccatcccagggtacaacagaacagattctgtgattaggctgttgtctgccattctcagagtttcagaagttgaatctcgagcaataagagcagatctcactcatctactaagtccccagatgggcaaagatattgtttggtttttaaaacgctgggcaaagacttatctcctggtggatgaaaaactgtatgatcagataagtctgccattcagtacagcgttcggagcagatacagagggttctcagtggataattggctacctcttacaaaaagtcatcagtaacctctcagtctggagtagtgagcaggaccttgcaaatgacactgtgcagctccttgtcactttggtggaaagaagagaaagggcaaacttagtaattcaatgtgagaactggtggaatttagctaagcagtttgcaagccgaagcccacctcttaatttcttgtcaagtcctgtgcagaggacattgatgaaggctctagtcttaggaggttttgcacatatggacacagaaaccaaacagcagtattggacagaggttcttcagccacttcagcagcgattcttaagagtgataaaccaagaaaacttccagcagatgtgtcagcaagaggaagtcaagcaggaaatcactgccacactagaggccctgtgtggcattgctgaggctacccagattgacaacgtagcaatcctgtttaattttttaatggacttccttaccaattgcattggattgatggaagtttacaagaataccccagagactgtcaatctcattatagaagtttttgttgaagttgcacataaacagatatgctatcttggagagtccaaagctatgaacttatatgaagcctgccttactttgttgcaagtgtattctaagaataatttagggcggcaaagaatagatgttacagcagaagaagagcaataccaagacctgcttctcattatggaacttcttactaacctgctgtcaaaagaattcatagatttcagtgatacagatgaagtgtttagaggacatgagccaggtcaagcagcaaacagatctgtgtcagcagcggatgttgtgttgtatggagtaaacctaattctgcccttgatgtcacaggatctcttgaagtttccaaccctttgtaatcagtactacaaattaatcacatttatctgtgagatttttcctgaaaaaataccacagcttcctgaggatctgtttaaaagtctgatgtactccctagaattaggaatgacatcaatgagttcggaggtttgccagctttgcctggaggccttgacaccgttagctgaacagtgtgcaaaagcacaagaaacagactcaccactttttctagcaacacggcactttcttaagctggtttttgatatgctggttttgcaaaagcacaacacagagatgaccactgcggctggcgaagctttctacacgttggtgtgtttgcaccaggctgaatattctgaactggtcgaaacattactatcaagtcagcaagacccagttatttaccagagattagcagatgccttcaacaagctcactgcaagcagcactcctcctacgctggatcggaagcagaagatggccttcttaaagagtttagaagaatttatggcaaatgttggtggtctcctttgtgtaaaataaacaacagaactttatgcttaatttaaaaaaaaaaaaa

SEQ ID NO: 513 - DNA, 2847 bp, Homo sapiens
  CDS (521)..(2038)
tacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttcagctctccacactaagggcaagatcgaaacacggcacgtggctgccatggagaagtaaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagagcaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcaggtgttgatagttgttttaaggattgttaggtataggaaatccagtaaattaataaaaaaattttgattttccaataaaaaaaaaaaaaa

SEQ ID NO: 514 - DNA, 593 bp, Homo sapiens
  CDS (70)..(513)
cgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccaggtgtcctggagcctggaccacaagagcgcccacgcaggcacctatgaggttagattcttcgacgaggagtcctacagcctcctcaggaaggctcagaggaataacgaggacatttccatcatcccgcctctgtttacagtcagcgtggaccatcggggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggaaaaaaaaaaaa

SEQ ID NO: 515 - DNA, 1560 bp, Homo sapiens
  CDS (77)..(1267)
gcggtggcattcgaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatga

SEQ ID NO: 516 - DNA, 917 bp, Homo sapiens
  CDS (53)..(823)
gaggagccggccgggcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtaaaaaaaaaaaaa

SEQ ID NO: 517 - DNA, 3034 bp, Homo sapiens
  CDS (729)..(917)
tagtgttgggtcacctcactatatgtctttaagaacattaaaactatggaaaatttgtctagcatatcagaagttgtaaatgctatatctggtatccagaggctggctgtaaaaagttccttggggtcactctatctcacattttttttggttagcattttaaaaatgcaaagccacatactttgaaatatattattccaaattgagctcccttccctttgcacatattttttcctccccttattgaagtcagctctaaccccaaattctagtatccaaaagtatttttatttgtataatgctatctgaaaaatgtgtttatattatattttcagagctgcaattcttattcgccatttcaatacctagagatagagagtcttgtatttgaagccacacacactggtgtaatatgcttagtactctaggtcaaggatttgttggtaaatggaacattttagcatagtcatgatttttggttgcctagacatcaggtaaacattcagtacactaaagaaactatcctggacactccctcctgcttccaccaatttttttctcacccccttttcaaaaattgaaaactctatgagtgtctttttgagaccataaagcagactttagtaactttctatttctgtaagtactaaatgtctggcattttaaacttttgtagaatacattatgttggacactggaataatactatttattttcacctgtgaaaaatgacttcattgtacttgaaacacctcctttgcatttctccatttgtgccattcactagtggaaataaattgtattataccatgatctactggctttttaaaactgtattaaatatgcacatttttggtatagctattatcatttgtatgtatatattgtatatacatatgagtgtctgtatgtgtgtatagatggatggatgtaactcatactgtacatttccatcagggcacttaaaagttctgttatttttgtttggttttgttatttcagtcctcagttaaggcaagaatgcatgtgtttcttaagaatgagtactctgcgttgatgtttatgagaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgattcccaagaattcccccaaaagttcgggtcattcaacctgcacagcgttctttcactctaaagcgtcagcacttgtgagtgaaaaatcatgtaattatctcgtaatattgagcctaaccacatcgaccctacgttcctgtatttttctcggctttggtcccttaagtttatataggccttggccacccttgagaaggaagttcctgtcattaacccaggtgctggtctcagcagttatatcttg

SEQ ID NO: 518 - DNA, 3024 bp, Homo sapiens
  CDS (240)..(2861)
gcgggggccgaagcaccgcctacgtcgggctgcgtgacaatggggccggcggcagaacgcagctgcggcgactgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgccgcctcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgactttagctccgccgagtcgggctcctcgctgcgctactacagcgagggtgagagcggcggcggcggcggcggcagctccttgtcgctgcatccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataacaaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactcttgaaggacatgaatggcctaaaactgatttttttttttttccgttaaaatgtgtgtgtcaagatacggagatttcagggttaaagtatatttcagttttctttagggcaacatatatttgaatttaaaagcactttatttaaaaaaaaaaaaaaa

SEQ ID NO: 519 - DNA, 4836 bp, Homo sapiens
  CDS (15)..(1490)
ggggtcggcggaagatggcggccggcgaaaggagctggtgcctgtgcaagttgttgaggtttttttattcattattcttccctgggctcattgtatgtggaactttatgtgtgtgtttggtcattgtcctttggggaatcagactgctgctacagagaaagaaaaaattagtgtcaactagcaaaaatgggaaaaatcaaatggtgattgcattttttcatccatactgcaatgctggtggaggaggagaaagagttttatggtgtgctttaagagccctgcagaaaaagtatcctgaagcagtttatgttgtttataccggcgatgttaatgtcaacggtcaacagatactagaaggtgctttcagaagatttaacatcagattaattcacccagtgcagtttgtttttttaaggaaacgctatcttgtggaagattcactgtatcctcacttcacactgctgggccaaagtctaggatccatttttcttggctgggaagctctaatgcagtgtgttcctgatgtttacattgattcaatgggatacgcttttacgcttcctctgtttaagtatatagggggttgccaagttggaagctatgttcattatcctactatcagcaccgacatgctctctgtagtgaagaatcaaaatattggatttaataatgcagccttcattaccaggaatccttttctcagcaaagtaaagctcatctactactatttatttgcttttatttatggacttgttggttcttgcagtgatgtagtcatggtcaattcttcttggacactaaaccatattctctcactatggaaagttgggaattgcactaacattgtttatccaccttgtgatgtgcagacatttctggacattcccttacatgagaaaaagatgaccccaggacatttgctggtttctgttggccagtttaggccggaaaagaatcatccattgcagatcagagcctttgctaaattgctgaataagaagatggttgagtcacctccttcgcttaaacttgtcctcattggaggttgtcgtaacaaagatgatgaacttagggtaaaccaactgagaaggctgtctgaggatttaggagttcaagaatatgtggaatttaaaataaacattccatttgatgaattaaagaattatttgtctgaagcaacaattggtctgcataccatgtggaacgagcattttgggattggagttgtggagtgtatggcagctggcacaattatccttgcacacaattcggggggcccaaagcttgacattgtggttcctcacgaaggagatataactggctttctggctgagagtgaagaagactatgctgaaactatcgctcacattctttccatgtctgcagaaaagagactccaaatcagaaaaagtgctcgtgcatctgtaagcagattctctgatcaggaatttgaagtgacattcctatcatctgtggaaaagttatttaagtaatgccatatctgtaaaattaaagatattttatataaactggttaaacaccttcatatgtaaatatttttctaaattcaatctcatttgtcaaatcattttactttagaaaacagacaaaatttccttttagaataaaaggaagtgttgaaaaaaaaatggatgactagccttcggcttccattcttggtatacatgagagaggctggctgctgagatgaatgtgaaccaggttgcagagaatctggctttgagccaccaggaagaactagtggatttgccaaaaaactaccccttgagtgaaaatgaagatgagggggacagtgatggagagagaaagcatcaaaagcttctggaagcaatcatttcccttgatggaaagaataggcggaaattggctgagaggtctgaggctagtctgaaagtgtcagagttcagtgtcagttctgaaggatcaggagaaaagctgggccttgcagatctgcttgagcccgttaaaacttcatcttctttggccactgtaaaaaagcaactgaatagagtcaaatcaaagaaggtggtggagttacctcttaacaaagaaaaaattgaacagatccacagagaagtagcattcagtaaaacctcacaggtcctctccaaatgggaccctatcatcctgaagaaccagcaggcagagcagctggtttttcccctggggaaggagcagccagccattgctcccattgaacatgcgctcagtggctggaaggcaagaactcccctggagcaggaaatttttaacctcctccataagaacaagcagccagtgacagatcctttactgactcccatggaaaaggcctctctccaagccatgagcctggaagaggcaaagatgcaccgagcagagcttcagagggctcgggctctgcagtcctactatgaggccaaggctcgaaaagagaagaaaatcaaaagtaaaaagtatcacaaagtcgtgaagaaaggaaaggccaagaaagccttaaaagagtttgagcagctacagaaggttaatccaactgtggcactggaagaaatggaaaaaattgaaaatgccagaatgatggaaagaatgagccttaagcaccaaaacagtgggaaatgggccaagtcaaaggcaattatggccaaatatgacctggaggctcgccaagctatgcaggaacagttggccaagaacaaagaactgacacagaaactccaggtagcctctgagagtgaggaagaggagggaggcacagaagtggaagaactccttgtccctcatgtagcgaatgaagtgcagatgaatgtggacggaccgaatccctggatgttcaggagctgcaccagtgacaccaaagaggctgcaacacaggaggaccctgagcaagtgccagagcttgcagctcatgaggtttctgcaagtgaggcagaagaaagaccagtggcagaggaagaaattttgttgagagaatttgaggaaaggcaatcccttagaaaaagatctgagctcaaccaggatgctgagccagcaagcagtcaagaaacaaaagattctagcagccaggaggtgctgtccgaattgagggcactatctcagaaattgaaggaaaaacatcagtccaggaagcaaaaagcaagttcagaggggactgttccccaggtccagagagaggaacctgccccagaagaagcggaacccctattgctacagaggtcagagagagtacaaactctggaagagctagaagagctgggaaaagaagattgttttcaaaataaggagcttcccagacctgtgttagaaggacagcagtcagagaggaccccaaataatcggcctgatgcccctaaggagaagaaagagaaggagcaactgatcaacctacagaacttcctgaccacacagtctccttccgtgaggtctttggcagttcccacaataatagaggagctggaagatgaagaggagagagaccaaaggcagatgataaaggaagcttttgctggggatgatgtcatcagagatttcttgaaagagaagagggaagctgtggaggcgagtaagccaaaggacgtggacctgacactacctggctggggcgagtggggtggtgtgggcctaaagcccagtgccaagaaaagacgccagtttctcattaaagcccctgagggtcctccaagaaaagataagaatttgccaaatgtgattatcagtgagaagcgcaacatccacgcagcagctcatcaggtacaagtgcttccatatccatttacccaccatcggcaatttgaaaggaccatccagacccctataggatccacatggaacacccagagggctttccaaaagctgactactcccaaggtcgtcaccaagccaggccatatcattaagcccataaaagcagaggatgtgggctaccagtcttcctcaaggtcagacctgcctgtcatacagaggaatccaaaacgaatcaccacacgtcacaataaagaagaaaaactgtaggttgtgtagctggagaagtgacagtcaggggccctgattccacttcctttggtccagttttactctgctacagggtggattccaaaactggctcagcacattgcatgtagttgagccacattttttaaaaaaagaaaatggatgaccattaattgactagcattttagaattgatcagacattagaacacagaaaaattctagtacatttaaattctaaacaatacagtggatgacccttttgaatatacctaatgatttccttaaaaaagaaattttaaacagacttgtttaatcgtgttctcaaagcatacagtcaagaggtgggactgactgatgctttataggtgtgtgtagggtggtagaggccaaggtgctgccagcaatcctttccatactaggtactggtgaaaattgtttttgtttatgctgtcagcacatttgtgtgggtctctcattgtcccttaacagtgccgcatctcagcctggaagtcagctttaagtcattcaagagaacctcaggctgtttttctgacagtgatgatatgatatacagatacatccacagggtatctattaccagcataatgcattgtaagatggcaaggtggcattttgaaagagcgctgggcaagcagttagcacatctgggcctaccttcagcttcttcatttacaaacttctgaccttttgacactaaagctgctcctttatctttctgagtctcagattcttcatctgtaatctggagttgttaattccagtccttactaccttttagagttggaatgagatggaaagtagatgaaactactttgaaaattacgac

SEQ ID NO: 520 - DNA, 1917 bp, Homo sapiens
  CDS (80)..(628)
  misc_feature (1)...(1917): n = a,t,c or g
aaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctcccaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttgggcatgtaagaaataagcatttacataattggaaaaatctggatttctgatgccaaagggttaaagcttcttggatttcatttcattgatatacagccactattttatttttgatcagtggcctttggggccacctgttcagggtactgaccatcagtgtcagcattagggttttggtttttggttcttttgggtatttccttttgggccatgtgattcttgtttgtggtacaatggaagttacttcctcttggtcctcgatgatggggtttaaactaaaggagcattcggntttggcattgggatagaaccggatagtgtggcagtgtcaatttagtacgagtgcaatttttttgggatttgcggggcacaccaagaggttttattatattatgttggaggtttgtggaaacattccggtgggaaagattatagagtgcactaaagtgctgtgttggacacaaaaataaagtgacacgggaaataagagagagggactgtgattgctagggata

SEQ ID NO: 521 - DNA, 1992 bp, Homo sapiens
  CDS (80)..(703)
  misc_feature (1)...(1992): n = a,t,c or g
aaggcagcggggcggcggcggcggcggcggcggctgtggaggccgcagtccgggtcctggcttcggcctcagccccaccatggtgacgcttgctgaactgctggtgctcctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaaggtggtggagatacctgggatgctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttgggcatgtaagaaataagcatttacataattggaaaaatctggatttctgatgccaaagggttaaagcttcttggatttcatttcattgatatacagccactattttatttttgatcagtggcctttggggccacctgttcagggtactgaccatcagtgtcagcattagggttttggtttttggttcttttgggtatttccttttgggccatgtgattcttgtttgtggtacaatggaagttacttcctcttggtcctcgatgatggggtttaaactaaaggagcattcggntttggcattgggatagaaccggatagtgtggcagtgtcaatttagtacgagtgcaatttttttgggatttgcggggcacaccaagaggttttattatattatgttggaggtttgtggaaacattccggtgggaaagattatagagtgcactaaagtgctgtgttggacacaaaaataaagtgacacgggaaataagagagagggactgtgattgctagggata

SEQ ID NO: 522 - DNA, 1220 bp, Homo sapiens
  CDS (370)..(1140)
taccgccaccgccgccgccgattccggagccggggtagtcgccgccgccgccgccgccgctgcagccactgcaggcaccgctgccgccgcctgagtagtgtaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgctatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaa

SEQ ID NO: 523 - DNA, 2401 bp, Homo sapiens
  CDS (170)..(2116)
aaagcaacagattctagaactggagaagaaagtaaatgaagcaaagagaactcagcaagaatattatgaaagggaacttaaaaacctgcaaagtagattggaagaggaggtgactcaattaaacgaggcccattctaagactttggaagaattagcttggaagcaccatatggcaattgaagctgtccacagtaatgcaattagggataagaaaaaactgcaaatggatttggaagaacaacataacaaagataaactaaacctggaagaggataaaaatcagcttcaacaagagctagaaaacctaaaggaagtactggaagacaagttgaatacagccaatcaagagattggccacctccaagatatggtaaggaaaagtgaacaaggtcttggctctgcagaaggacttattgctagtcttcaggactcccaggaaaggcttcagaatgagcttgacttgactaaagacagcctaaaggagaccaaggatgctctattaaatgtggagggtgagctagaacaagaaaggcaacagcatgaagaaacaattgctgccatgaaagaagaagagaagctcaaagtggacaaaatggcccatgacttagaaattaagtggactgaaaatcttagacaagagtgttctaaacttcgtgaagagttaaggcttcaacatgaagaggataagaagtcagcaatgtctcaacttttgcagttgaaagatcgagagaaaaatgcagcaagagattcatggcagaagaaagtagaagatctcttaaaccagatttccttgctgaaacagaatctggagatacagctttcccagtctcagacttctttgcaacaactgcaagcccagtttacgcaagaacgacagcggcttacgcaagagcttgaagaattagaggagcaacatcagcaaagacacaaatcattaaaagaagcacatgtccttgcatttcaaactatggaagaggaaaaggaaaaggagcaaagagctcttgaaaatcatttacaacagaagcattctgcagagcttcaatcactaaaagatgcacacagagagtcaatggagggcttccggatagaaatggaacaggaacttcagactcttcggtttgaattagaagatgaaggaaaggctatgcttgcttccttgcgctcagaactcaaccatcaacatgcagctgcaattgatttgttacggcataatcatcatcaagaattggcagctgctaaaatggaattagagagaagcatagacatcagcagaagacagagtaaggagcacatatgtagaattacagatctacaagaggaattaagacacagagagcatcacatctctgaattggataaggaggttcagcaccttcatgagaatataagtgccctaaccaaagaactggaatttaaggggaaagaaattctcagaatacgaagtgaatctaaccaacagataaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcattagaagaaatggaagaaaaatatctaatgagagaatcaaaaccagaagatatacagatgattacagaattaaaagccatgcttacagaaagagaccagatcataaagaaactaattgaggataataagttttatcagctggaattagtcaatcgagaaactaacttcaacaaagtgtttaactcaagtcctactgttggtgttattaatccattggctaagcaaaagaagaagaatgataaatcaccaacaaacaggtttgtgagtgttcccaatctaagtgctctggaatctggtggagtgggcaatggacatcctaaccgcctggatcccattcctaattctccagtccacgatattgagttcaacagcagcaaaccacttccacagccagtgccacctaaagggcccaagacatttttgagtcctgctcagagtgaagcttctccagtggcttctccagatccccagcgccaggagtggtttgcccggtacttcacattctgaaagaattgtgttggcacagctctgtatagactgttactaagagcatgactttatacagattgttatgtaaataggctttcctatgtcaaacactgtgaatgagaaagtatttgtctctccaacttgaaaatgcactgtatttcctgtgatatttattggaatcattctataaggtactatattatgtgtgtaattataactgttatttttatttgagatggaagagtctttaacctttgtaattactgcataataaattttgttagaatcaaaaaaaaaaaa

SEQ ID NO: 524 - DNA, 1715 bp, Homo sapiens
  CDS (157)..(1365)
caacgggagagaggaagctctagtgagaacaggtgatagaggcataacttctaagttgggatagtggagcagccgccgcagctgcggggccgccgcttggctctgggacagggagcgcacggagagttggcgaggaaatgtaatgtcctcctctgtatgcatcagtctttcctcacgaggttaatttccagtcagcatcagaaaaggttgagcatctctcaccttaaaaaaaaaagggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttccttcccacgtttttatggatctgcaccagactgttacccttttgggggaagtggagatttgactgttaaaactgaaacagcgagtatctttt

SEQ ID NO: 525 - DNA, 518 bp, Homo sapiens
  CDS (49)..(195)
ggggcttgcgacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggatcaaactcttcattgaagtactcatcaggcgtgatggctgtggggttgtttgcagtagcacattccgtggtgaggtcctgctgagccagaactcaggagagtcagaaatgccaaatgatgttcacaagtgaaggcctgtggcactcagtgtctgaggtggacgtgttaaccagctaaagaccgggaagttctattcactaacttttttgcatggaacaagaaaatctatgaggatatcaccaaactacacaggaagtgtaatggatttcttcattttaaaatatttctctactctcctttacatttttatctcctgattataacaaaaaaaaaaaa

SEQ ID NO: 526 - DNA, 3052 bp, Homo sapiens
  CDS (112)..(2307)
gatattgagccagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggagatatggtccttggagatgaactagatgacctgcttgattctgcacctgaaactaatgaaactgttatgccgtcagctttagtcagaggaccccttcagacagccagtgtctctcctagcatgcccttttcggcatcgctgttaggaaccttacccattggtgcgaggtatgctcctccaccctccttctcagaattttatccacctttgacttcatccttagaagatttttgttcttctttaaattcattttcaatgagtgaatccaaacgagatctgtccacctcaacttctagagagggaacaccgcttaacaacagtaattcttcccttttacttatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggccctaagttaatggatttcacttaccatgctaacatagatcataagtgtaagaaagatattttaatcggtaggataaagaatgttgaagataaatcatggaaaaaaatacgtccaagaccaacaaaaacaaattatgaaggaccatattatatatgtaaagatgttgctgctgaggaggaatgtagatattcaggccactgcacgtttgcttattgccaagaggagatagatgtgtggacactggagcggaaaggagcattcagccgggaggctttctttggcggcaatggaaagattaaccttactgtgttcaaacttctccaggagcatcttggggaatttatattcctttgtgagaaatgttttgatcataagcctagaatgataagtaaaagaaataaagataattctactgcttgttctcacccggttacaaagcatgagtttgaagacaataagtgccttgtccacattttgcgagagacaacagtaaaatactccaaaatacgttcttttcatggtcagtgtcagcttgatttatgtcgacatgaagttcggtatggctgtttaagggaagatgagtgcttttatgcccatagtcttgtggaactgaaagtctggataatgcaaaatgaaacaggtatctcacatgatgctattgctcaagagtctaaacgatattggcagaatttggaagcaaatgtacctggagcgcaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtggaccaaagaccggcgtgcgatgagagtgatgtctattgaacgtaagaagtggatgaacatccgtcctctccccacaaagaaacaaatgcctttacagtttgatctgtgcaaccatattgcttctgggaaaaaatgtcaatatgtgggaaactgttcctttgctcatagtcctgaggaaagagaagtttggacttacatgaaggagaatgggatacaagatatggagcaattttacgaactatggctcaagagtcaaaaaaaaaaaaaaagtgaagacatagccagtcagtcaaacaaggaaaatggaaaacaaattcacatgccaacagattatgctgaagttacagtggactttcactgctggatgtgtgggaaaaactgcaacagtgagaagcagtggcagggccacatctcctccgagaagcacaaagagaaggttttccacaccgaggacgaccagtactgctggcagcaccgcttcccaacaggctatttcagtatttgtgataggtatatgaatggcacctgcccagaaggaaacagctgtaaatttgcacatggaaatgccgaacttcatgaatgggaagagagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttcaaaaaaaaaaaa

SEQ ID NO: 527 - DNA, 1631 bp, Homo sapiens
  CDS (227)..(1285)
cccacgcgtccggggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgagggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttg

SEQ ID NO: 528 - DNA, 6151 bp, Homo sapiens
  CDS (263)..(3133)
tttcgtgctcgctcggtctccggctccggcgccggctcctgctcctcctggccgcccggggccaaggcgacgagaggttgtaaaaatccatgtgggacggccccggggcgagcatcggaaagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggaattgcaccgaagaagccaacttcagccggagccagccaagacgaaggctctccagactgtcatcgaaatgaaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaagattgaaaacttgcaagaacaacttagggataaagacaagcaactgaccaacctgaaagacagagtgaagtccttgcagacggattccagtaatacagatactgcactggcgacgctagaggaagctctgtcagagaaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagagcttgactctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaaacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcagacccagaacagaatgaagttgatggcagacaactatgatgatgaccatcaccattaccaccaccaccaccatcaccaccaccatcgatctcctgggaggtcgcaacattccaatcacaggccctctccggaccaggatgacgaggagggcatatgggcatagccgggcctgtaaaccaaagttccagttttgttttgagggctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttgggtatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaaaaaaaaaaaa

SEQ ID NO: 529 - DNA, 2651 bp, Homo sapiens
  CDS (147)..(1970)
  misc_feature (1)...(2651): n = a,t,c or g
aattctgtcgggcccgcccgctgacgtcacctgctagccccgcctcctctagggtcccgggcccctgcggcgggggctgccccgggggcagtcagttgaggcggcgggagctcggcggagggcgggccaggtgactggtccgggccatgccgaggaagaagccattcagcgtgaagcagaagaagaagcagttgcaggacaaacgggagcggaagagagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcgataccgactgcattttgagagagacagcagggaggaggtagagaggagaaagagagcagcccgggagcaagttctacagccggtcagtgctgagttgttggagctggacatccgggaggtgtatcagcctggctcagttctggactttcctcgacgtcctccttggagctatgagatgtccaaggagcaactaatgagccaagaggaacggagcttccaagactatcttgggaagattcatggggcttactcctctgagaaactcagctactttgagcacaatctggagacatggaggcagctgtggcgggtgttagagatgtctgacatcgtcctgcttatcactgatatccgacatccagttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggaccctagtagtgtcttgaagaagagtcggaggcgggggagaggatggactcgggccctggggccagagcagttgctgagagcctgtgaagccatcactgtggggaaagtggacttgagcagctggcgggagaagattgctcgggatgtggctggggccacctggggtaatggctctggggaggaggaggaagaggaggatggcccagcagtcctggtggagcagcagcagactgattcagcaatggagccaactggcccaacccaagagcgctacaaggatggggtggtgaccatcggctgtgtgggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtacacatcattccgagccgccttggctgtcttgtaaccacgtttctctgcccaggcttcacagatgtcccaggcacaccaggggtgttccgctgaggggtcctcagcctctgggtggcgcaggtggagcagggcctgcacgggaattcgggaggccaggtagcccacagcagtgtagggctcctggatctgggcgatagggtagatccctgccagaacctgagggaaatgagcactcagtactttcctcaatgtcccaccttctctctttcccttacccaccctccccgtcatacctgcaactgcctaggcagaagagatgggaagatgaggcctgggcagtcacagagcttcacagagggggtaagaaagtaggtctgaaagtatcgggtatggcccggggttctggagacactcacgactttccgccccaccagcccattgatcagcgaggactttccctcattagggaaacctgaggaaggcaaggaaaattaacgtttaacaggtttctactctgtgatgggacgaattcctgctctcgnggcatgatatgcattcaatgggggcggg

SEQ ID NO: 530 - DNA, 1274 bp, Homo sapiens
  CDS (696)..(959)
aatatactcttgttttcaatttctcttggcactcagagatgaatctgtgtgagcacggagagctagagatctcagagcagccaggaactgagatgcaaatcatttcacctttgtgtggtctgctcattctgtagtctttgtcttacccttaaagtgggaaactctttgacagggaaatgccatgtttgaactgaagaagcctactttatagttttttctctcttgcctaatgttttcagtagcgtactatgttgggtgttttagtatgccacatggtctctattctctgaagctgtatgatgaaacaagtacctaactttaacaggagataattaatgtcttaagggaagtactaacagaattgctttagagtctgggattttttttttattgcaagaactatttttcatggtggaaaggagaatttatattaaagaaccagtgggctcctgggcccaccatggcacatttagccttcactgggaagtagaactaaatgaaagccatcagcagccaacacagcttcacttcagctcattgtatctgaatccagtgttcccaaggacatcagtgactttatttttttgaaaactgtaatgctttaaaacttactttattggatctctttgcagcttttgacacagtgaaccactttcctttcctgaaatgctttcctctcttggctttctgatgccatgttctcctgtttcttctctacttctctggccacttctgtctccttagaagctcagtcttgctttgcctggcccttgattgttagttttccccagggctcacttcttagcccctttctcctcatgtcttataatttgagtcatctcatctactctggggagttgaatggtcgcttgtatgctgaaaactcccaaatttgtatctgtagcccagcttttcctactaagctctacttacatatctttgcagacctcattacttcttgactaacttactggctccttaaatatctaaaattgaatccatgttctacctccccatacaaaaagttcctcctccttccctaccacagttaacagttaccattactctggccattactatcctggtctctctgcctcctgatgggagtcagctcctcctgtcaagttggcctccacagtggctttcacatgtctaccttccactctgctaatttctgagcagttaccacattcttgctcaacagtaggtaccagtcacctggattgcttattaaatagttgaattatggagccccaggaatgtagaaaatttac

SEQ ID NO: 531 - DNA, 2633 bp, Homo sapiens
  CDS (22)..(2370)
tttcgtcgcgtgccgggtgtcatggcggcctgcaggtactgctgctcgtgcctccggctccggcccctgagcgatggtcctttccttctgccacggcgggatcgggcactcacccagttgcaagtgcgagcactatggagtagcgcagggtctcgagctgtggccgtggacttaggcaacaggaaattagaaatatcttctggaaagctggccagatttgcagatggctctgctgtagtacagtcaggtgacactgcagtaatggtcacagcggtcagtaaaacaaaaccttccccttcccagtttatgcctttggtggttgactacagacaaaaagctgctgcagcaggtagaattcccacaaactatctgagaagagagattggtacttctgataaagaaattctaacaagtcgaataatagatcgttcaattagaccgctctttccagctggctacttctatgatacacaggttctgtgtaatctgttagcagtagatggtgtaaatgagcctgatgtcctagcaattaatggcgcttccgtagccctctcattatcagatattccttggaatggacctgttggggcagtacgaataggaataattgatggagaatatgttgttaacccaacaagaaaagaaatgtcttctagtactttaaatttagtggttgctggagcacctaaaagtcagattgtcatgttggaagcctctgcagagaacattttacagcaggacttttgccatgctatcaaagtgggagtgaaatattcccaacaaataattcagtgcattcagcagttggtaaaagaaactggtgttaccaagaggacacctcagaagttatttaccccttcgccagagattgtgaaatatactcataaacttgctatggagagactctatgcagtttttacagattacgagcatgacaaagtttccagagatgaagctgttaacaaaataagattagatacggaggaacaactaaaagaaaaatttccagaagccgatccatatgaaataatagaatccttcaatgttgttgcaaaggaagtttttagaagtattgttttgaatgaatacaaaaggtgcgatggtcgggatttgacttcacttaggaatgtaagttgtgaggtagatatgtttaaaacccttcatggatcagcattatttcaaagaggacaaacacaggtgctttgtaccgttacatttgattcattagaatctggtattaagtcagatcaagttataacagctataaatgggataaaagataaaaatttcatgctgcactacgagtttcctccttatgcaactaatgaaattggcaaagtcactggtttaaatagaagagaacttgggcatggtgctcttgctgagaaagctttgtatcctgttattccccgagattttcctttcaccataagagttacatctgaagtcctagagtcaaatgggtcatcttctatggcatctgcatgtggcggaagtttagcattaatggattcaggggttccaatttcatctgctgttgcaggcgtagcaataggattggtcaccaaaaccgatcctgagaagggtgaaatagaagattatcgtttgctgacagatattttgggaattgaagattacaatggtgacatggacttcaaaatagctggcactaataaaggaataactgcattacaggctgatattaaattacctggaataccaataaaaattgtgatggaggctattcaacaagcttcagtggcaaaaaaggagatattacagatcatgaacaaaactatttcaaaacctcgagcatctagaaaagaaaatggacctgttgtagaaactgttcaggttccattatcaaaacgagcaaaatttgttggacctggtggctataacttaaaaaaacttcaggctgaaacaggtgtaactattagtcaggtggatgaagaaacgttttctgtatttgcaccaacacccagtgctatgcatgaggcaagagacttcattactgaaatctgcaaggatgatcaggagcagcaattagaatttggagcagtatataccgccacaataactgaaatcagagatactggtgtaatggtaaaattatatccaaatatgactgcggtactgcttcataacacacaacttgatcaacgaaagattaaacatcctactgccctaggattagaagttggccaagaaattcaggtgaaatactttggacgtgacccagccgatggaagaatgaggctttctcgaaaagtgcttcagtcgccagctacaaccgtggtcagaactttgaatgacagaagtagtattgtaatgggagaacctatttcacagtcatcatctaattctcagtgattttttttttttaaagagaattctagaattctattttgtctagggtgatgtgctgtagagcaacattttagtagtatcttccattgtgtagatttctatataatataaatacattttaattatttgtactaaaatgctcatttacatgtgccatttttttaattcgagtaacccatatttgtttaattgtatttacattataaatcaagaaatatttattattaaaagtaagtcatttatacatcttagaaaaaaaaaaa

SEQ ID NO: 532 - DNA, 4113 bp, Homo sapiens
  CDS (1030)..(3870)
gataggacgaagaaaccgaagggaaagctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcagtcttgcctccagcaaatccatcctccaatcctgatgccagagtgatctgaaatgcaaatatgatcttgccactcccctgcttaaaacccaccaaccgcagtggttctgtaaccacagtgtagcctctgacgtgggctgaaagcacaaagccaggctatttgatctctggagaaggatcctttcccttcctgcttgggttccacctgcaccctatgacttcgggtggaaactgctgtctgatcagccaccttgcccacacacttggacatctgtactgtctctgatcccttctctcctcaccaacaggctggaccccacatccacccctctgaatcaaatcattccgcttccccttagcctcagctctttcttctgggttgtttgtattttcttttctgtcccaaacagtttcccccacaaaaagaactttatgtctttctctgtcttccctcagtccttccagtcagcagcctgtgattgggcttttcccctcagaaacgaacaatccagaacccactgtttaaaacaactgtattttgccttgggaagtcccattgccttccctgaaaacattaaacattcctccgatccccagcctgagtctctctgtctctgggccccatcctgctccacagcagggctggtgtgtccagcacagagtgaccctccgatgccctttcccacccgccgccctgcctccctcgagccctgccttccctcacttcccagtctcctctgcttctggcagctttgggacccccgcccctggcttctcctccatgctgtatggaatgaagattgcaaatctggcctacgtcaccaagactcgggtcaggttcttcagactcgaccgctgggccgacgtgcggttcccagaaaagaggagaatgaagctggggtcagatatcagcaaacaccacaagtcactgctagccaagatcttttatgacagggctgagtatcttcatgggaaacatggtgtggatgtggaagtccaggggccccatgaagcccgagatgggcagctccttatccgcctggatttgaaccgcaaagaggtgctgaccctgaggcttcggaatggcggaacccagtctgttaccctcactcacctcttcccactctgccggacaccccagtttgctttctacaatgaagaccaggagttgccctgtccactgggccccggtgaatgctatgaactccatgtccattgtaagaccagctttgtgggctacttcccagccacagtgctctgggagctgctgggacctggggagtcgggttcagaaggagccggcacattctacattgcccgcttcttggctgccgtcgcccacagccccctggctgcacagctgaagcccatgactcccttcaagcggacccggatcaccggaaaccctgtggtgaccaatcggatagaggaaggagagagacctgaccgcgctaagggctatgacctggagttaagtatggcgctggggacatactacccacctccccgcctcaggcagctgctccccatgcttcttcagggaacaagtatcttcactgcccctaaggagatcgcagagatcaaggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggttcctggagtgactgagagccgcccctcagtgctacggggcgaccacctgtttgcccttttgtcctcggagacacaccaggaggaccccatcacatataagggctttgtgcacaaggtggaattggaccgtgtcaagctgagcttttccatgagcctcctgagccgctttgtggatgggctgaccttcaaggtgaactttaccttcaaccgccagccgctgcgagtccagcaccgtgccctggagctgacagggcgctggctgctgtggcccatgctctttcctgtggcacctcgggacgtcccgctgctgccctcagatgtgaaactcaagctgtacgaccggagtctggagtcaaacccagagcagctgcaggccatgaggcacattgttacgggcaccacccgtccagccccctacatcatctttgggcctccaggcaccggcaagactgtcacgttagtggaggcaattaagcaggtggtgaagcacttgcccaaagcccacatcttggcctgcgctccatccaactcaggggctgacctactctgtcaaaggctccgggtccaccttcctagctccatctaccgcctcctggcccccagcagggacatccgcatggtacctgaggacatcaagccctgctgcaactgggacgcaaagaagggggagtatgtatttcccgccaagaagaagctgcaggaataccgggtcttaattaccaccctcatcactgccggcaggttggtctcggcccagtttcccattgatcacttcacacacatcttcatcgatgaggctggccactgcatggagcctgagagtctggtagctatagcagggctgatggaagtaaaggaaacaggtgatccaggagggcagctggtgctggcaggagaccctcggcagctggggcctgtgctgcgttccccactgacccagaagcatggactgggatactcactgctggagcggctgctcacctacaactccctgtacaagaagggccctgatggctatgacccccagttcataaccaagctgctccgcaactacaggtctcatcccaccatcctggacattcctaaccagctctattatgaaggggagctgcaggcctgtgctgatgtcgtggatcgagaacgcttctgccgctgggcgggcctacctcgacagggctttcccatcatctttcacggcgtaatgggcaaagatgagcgtgaaggcaacagcccatccttcttcaaccctgaagaggctgccacagtgacttcctacctgaagctgctcctggccccctcctccaagaagggcaaagctcgcctgagccctcgaagtgtgggcgtcatctccccgtaccggaaacaggtggagaaaatccgttactgcatcaccaaacttgacagggagcttcgaggactggatgacatcaaggacttgaaggtgggttcagtagaagaattccaaggccaagaacgaagcgtcatcctcatctccaccgtgcgaagcagccagagctttgtgcagctggatctggactttaatctgggtttccttaagaaccccaagaggttcaatgtagctgtgacccgggccaaggccctgctcatcatcgtggggaacccccttctcctgggccatgaccctgactggaaagtattcctggagttctgtaaagaaaacggagggtataccgggtgtcccttccctgccaaactggacctgcaacagggacagaatttactgcaaggtctgagcaagctcagcccctctacctcagggccccacagccatgactacctcccccaggagcgggagggtgaagggggcctgtctctgcaagtggagccagagtggaggaatgagctctgaagacacagcacccagccttctcgcaccagccaagccttaactgcctgcctgaccctgaaccagaacccagctgaactgcccctccaagggacaggaaggctgggggagggagtttacaacccaagccattccaccccctcccctgctggggagaatgacacatcaagctgctaacaattgggggaaggggaaggaagaaaactctgaaaacaaaatcttgttctatgcaaaaaaaaaaaa

SEQ ID NO: 533 - DNA, 1336 bp, Homo sapiens
  CDS (192)..(680)
atggctgccgccgtcgctgctgccggtgcaggggaaccccagtccccggacgaattgctcccgaaaggcgacgcggagaagcctgaggaggagctggaggaggacgacgatgaggaggtactagggcctcgcggggtgcagagcgggaagcgggcccgctcgtggctagatgagaccctgtcggagagactatggggcctgacggagatgtttccggagagggttgcggaacatctccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggattttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgtttttttttttttttttttaaagaatggagttgttggggcgggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactgaaaaaaaaaa

SEQ ID NO: 534 - DNA, 1805 bp, Homo sapiens
  CDS (103)..(936)
agctccgcgaattcccgggtcgacgatttcgtcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaacctccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtaaaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaaagaaaagaaaaaaggaaaaaaaaaaa

SEQ ID NO: 535 - DNA, 1854 bp, Homo sapiens
  CDS (103)..(984)
agctccgcgaattcccgggtcgacgatttcgtcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtaaaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaaagaaaagaaaaaaggaaaaaaaaaaaa

SEQ ID NO: 536 - DNA, 1535 bp, Homo sapiens
  CDS (279)..(650)
cgacgatttcgtgggatcagcagaagcctagaattacagattctgcactgaatggtcaaatacagctggagacatctccggtgtgtgaggtgcaaagtgatctaacattacagagtaacgggagccagtattctccaaattagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaa

SEQ ID NO: 537 - DNA, 1175 bp, Homo sapiens
  CDS (113)..(664)
gctctcacactaagtgaagcttctccattctgtaagctttccgggaacatccaaggcaagactggcacccagcacagcagtgactgaccacataccccactctccaggacccatggagtccttcagctcaaagagcctggcactgcaagcagagaagaagctactgagtaagatggcgggtcgctctgtggctcatctcttcatagatgagacaagcagtgaggtgctagatgagctctaccgtgtgtccaaggagtacacgcacagccggccccaggcccagcgcgtgatcaaggacctgatcaaagtggccatcaaggtggctgtgctgcaccgcaatggctcctttggccccagtgagctggccctggctacccgctttcgccagaagctgcggcagggtgccatgacggcacttagctttggtgaggtagacttcaccttcgaggctgctgttctggctggcctgctgaccgagtgccgggatgtgctgctagagttggtggaacaccacctcacgcccaagtcacatggccgcatccgccacgtgtttgatcacttctctgacccaggtctgctcacggccctctatgggcctgacttcactcagcaccttggcaagatctgtgacggactcaggaagctgctagacgaagggaagctctgagagccctgagcctagcacattccaccttgacaaaatggttgactgagaaaacacagataatgggcttcctaaccctgctcacctggcactaacacttttcaatcttcaggcttcattccttcccaagagtgcttttgactctgagaccagcccacccccaaacagctagtggagaaggagcaatgctgaggggtgaggcctctctcccactccagccccaggacaggaaacagaactgcctgaaaaaggtgaagtgaaacttggatctctatttctcccataagggacttctgaaacagggaagccccctcccatgtgaaccaaggaaaggaggcacagcccagagaacccctttggggatactaaagacagaagaggggaaggtggcccttagagacagagcttggacagatgccagaggctctgttccagagtgcaggaagaaggggctagggcaggggagattctcataggggaaataaaactactaaaatatgaaaaaaaaaaa

SEQ ID NO: 538 - DNA, 3990 bp, Homo sapiens
  CDS (563)..(3784)
tctttcccaataatacagtgaagggagtggaggattccataagcaatggccaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaaccaaatgctccagtgactgtcattcaaagtaaagctccaattccttgtgaagttgttaaggctacagttatccagaattccataccccagacaggagttcctgttagtattgctgttggaggaggacctccacagagttctcttgttcagaatcatagtacagggccacaacctgttacagttgtgaattctcagacatgcttcaccatccatctgtaattccacagcagtctccattacacacaggggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaaccggtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagccaattcaacaaccacagcagccaacccaacaaagcgtagtgattgtaagccagccagctcaacaaggtcatacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgggtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaaaaaaaa

SEQ ID NO: 539 - DNA, 2003 bp, Homo sapiens
  CDS (364)..(1536)
  misc_feature (1)...(2003): n = a,t,c or g
gaaaacaaaaacaatcggccgcgccgtcgcaggcacccgaacgtcgcgagcggggcctggggacgcggggccgagtgcagcgagcgaacgggagcagcggcgactcgccagtggggctagggcgccatggtggcatggctggggctcctgtgctgcgctgtggtgctccccctgtgctgcctgcggctagtgcgccctgcctgcctctgtgcctgcctcatgcctccctgctgcctgccctgctttggtgtgaactgatgggagcagtgacgctggcnctcggctggtggccctgtggcctgaactggcttgcgggacaccttgggcggcctgagtgatgccgagctgccgccgcctccgtgcatggatcagtgcgtgacggtggagcgcgagctggagaaggtgctgcacaagttctcaggctacgggcagctgtgcgagcgcggcctggaggagctcatcgactacaccggcggcctcaagcacgagatcctgcagagccacggccaagatgctgaattatcagggacactttcacttgttttgacacagtgctgtaaaagaataaaggatactgttcaaaaattggcctccgaccacaaagacatccacagcagtgtttctcgggttggaaaagccattgataagaattttgattctgacattagcagtgtgggaatagatggctgctggcaggcagacagccaaaggcttctcaatgaagtgatggtggagcacttctttcgacaaggaatgctggatgtggctgaggagctctgtcaggaatctggtctttctgtagacccaagtcagaaggaaccatttgtggagttaaatagaatattagaggcattaaaggtcagagttctgagacctgctctggagtgggcagtgtcaaaccgggaaatgcttatagctcaaaacagctccttggaatttaagctacacagactgtattttattagcttgttaatgggtggaaccacaaatcagcgagaggcattacaatatgctaaaaattttcagccatttgccctaaatcatcaaaaagacattcaggttttgatgggaagccttgtgtacctgagacaagggattgagaactcaccatatgttcacctacttgatgcaaaccagtgggctgatatctgtgacatctttacacgggatgcttgtgccctcctggggctctccgtggagtcccctctcagtgtcagtttctcagcaggttgtgtggcgctgccagctttaattaacatcaaagccgtgattgaacagaggcagtgtactggagtttggaaccagaaagatgaattacctattgaagtggaccttggtaaaaagtgctggtatcactctatatttgcctgccccattcttcgtcagcaaacaacagataacaatccacccatgaaattggtctgtggtcatattatatcaagagatgccctgaataaaatgtttaatggtagcaaattaaaatgtccctactgtccaatggaacaaagtccaggagatgccaaacagatatttttctgaagagataactttagtttgcaatttgtaagtgaaactgaatcgtgggtgcatttcagaagagaacgttccatataatgcagctaaccaaggactcctgtgtttctataagctaatgctccagaaactttgccaacctgttagtgtacacacactgaggggagtgctcccggtgaatattatcatagggctttattatattcttggtcttcatttctgatcaagtaaatacaccagcagttgtcattcaatgcaggtttttgtacttaattatatggtgatttttttactttttaagagcagaaacggaaattgacctccccgccatgtgtttaatattcctcctgcttttacttttgtcattttcttgataatcgtaagccttgagagtgtttgtgaaaaagttttatttcctgttatgtatacataattaaatgaaaattcttcagaaaaagttaaaaaaaaaa

SEQ ID NO: 540 - DNA, 2357 bp, Homo sapiens
  CDS (88)..(1173)
gaggcattacagcgaagtggccgagctggcaggacttcttcaggaaaatgctttcggatctatagtaaagattttgggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatggacctagcatagtgctttgcacatagtagtcactcagtgtttgttaaataaagctattagtgtcattaaaattcaaaaaaaaaaaa

SEQ ID NO: 541 - DNA, 2182 bp, Homo sapiens
  CDS (391)..(1644)
ggcacgagggccaggtacccaggggtcagcccacattcactaagaaaaagaagaccatccgtttgttctggaatagaaattcggccttttgactggccatgtaaaaacaaccgacgctgcagagaattcctgtggtcaaaactggaacccattaaggtggacacttccagactggagcacctgtttgagtctaaatccaaggaactgtctgtctcaaagaaaactgctgcagatggaaaaaggcaagagatcattgttctggattccaagaggagtaatgccatcaatattggtctgacggtgctgccccctccaaggacgattaagatcgccattttgaattttgatgagtatgccttaaacaaagaaggaatcgagaaaattctaacgatgattcccaccgatgaggagaagcagaaaatccaggaagctcagctggccaaccctgaaatccccctgggcagtgcagagcagttcctcctcaccctgtcctccatcagcgagctctctgcacgacttcacctctgggcattcaaaatggattatgaaactacagaaaaggaagtagcagaaccactcctggacctgaaggaaggaatagaccagttggagaacaataaaaccttgggctttatcctgtctactctcttagccattgggaactttctaaatggaactaatgccaaagcgtttgagttaagctacctcgagaaggttccagaagtcaaagacacagtgcacaagcagtcgcttctccaccatgtgtgcaccatggtggtagaaaacttcccagacagctccgatctgtactcggagatcggggccatcaccaggtcagccaaggttgactttgatcaacttcaggataatttatgtcagatggagagaagatgcaaagcttcatgggatcacctcaaggcaattgcaaaacatgaaatgaaaccagttttaaaacaacggatgtcagagttcctgaaagactgtgcagagcgaattataattttaaagattgtccatagaaggataatcaacagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgattctggcaagttctccggcagttctccggcgcccccaagccagccgcagggtctgagctatgcggaggacgcggctgagcacgagaacatgaaggctgtgctgaaaacctcgtccccctccgtggaggacgccacccccgcgctgggcgtccgcacacgcagccgagcaagccgaggatccactagttcctggactatgggaactgatgactcgcccaatgtcacagatgatgcagctgatgagatcatggaccgcatcgtcaagtcagccacccaagtgcccagtcagcgagtggtgccgagggagaggaaacgatcccgggccaaccggaaatctttgcgaagaaccctgaagagcggcctgaccccagaagaagccagagccctgggcttggttggcacctcggagttgcagctgtgacactcataggttactcccaggagtgtgctgagcagaaggcaagctcttgctggatgaaacccctccaggtggggttggggagacttgatattcacatccaacagtttgaaaagggagagctcaattcccagcgtcaccccatggcttgtgttgcctgctacgcattgacttggatctccaggagtcccctgcacataccttctccatcgtgtcagctgtgtttctcttgattccgtgacacccggtttattagttcaaaagtgtgacaccttttctgggcaaggaacagcccctttaaggagcaaatcacttctgtcacagttattatggtaatatgaggcaatctgattagcttcacagactgagtctccacaacaccaaaatatccagatgtaaaccccaaacttgtacacaaaagaaagcacagattgtttacctgttgtggattttagatgtaacaaatgtttatacaaatacatacatgtacaccatgtttcaaatactaaataaatagagtttaatgccaaaaaaaaaa

SEQ ID NO: 542 - DNA, 3818 bp, Homo sapiens
  CDS (708)..(3263)
  misc_feature (1)...(3818): n = a,t,c or g
cacgtcctgcctcgcttcgagacccacactgtgtatctgctcaccgtggcggctggctgtgtcagccccgccttagcgtctttttctcaaagccgtgtaaccgctgacaattctggtccgaggccaatccctgccctgacagtggagggatggttgcntccatctaaccgactcctgtaagctttggattcatgacggggtgaccatgacacggtgaggttacgaagaacatgcccaaccacttgtccagggcctgggtggcaggaaacctcggcttgggacggaaagggaatcatggttctcaaggcaggcatcattacttccgccacggtgggacagctgccctccctggagcctcaggatgtctctcttgctgactccaggggccatctttggagagtataggttttataaataagtcctgaaaccatgtcatcgcctatgtcgatgccacgattcacgaggccaccagaagagttgggcacccagtatgtcctcttcctagtcattttcagttcctgccaattcgggaggctctcctagagagcagcgcgaagccatggcttttgggcccggggacggaccgtagcgcgtagccggaagcggaggcgtggaggcgggtctgaggtttggtgactgcggggcaggccgggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggattggcacagctgcactggccgttcaggttgtgggcagtaactggcccaagccccactacactctgttgattacaggcctatgccgtttccagattgtacaggtcttaaaagagaagccatatcccattgctgaagtggagcagttggaccgacttgaggagtttcccaacacctgtaaaatgagggaggagctaggagaactatcagagcagttttacaaatatgcagtacaattggttgaaatgttggatatgtctgtccctgcagttgctaaattgagacgtcttttagatagtcttccaagggaagctttaccagacatcttgacatcaattatccgaacaagcaacaaagggaaactccagattttagatgctgtgagcctagaggagcggttcaagatgactataccactgcttgtcagacaaattgaaggcctgaaattgcttcaaaaaaccagaaaacccaagcaagatgatgataagagggttatagcaatacgccctattaggagaattacacatatctcaggtactttagaagatgaagatgaagatgaagataatgatgacattgtcatgctagagaaaaaaatacgaacatctagtatgccagagcaggcccataaagtctgtgtcaaagagataaagagactcaaaaaaatgcctcagtcaatgccagaatatgctctgactagaaattatttggaacttatggtagaacttccttggaacaaaagtacaactgaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggcgcacctatgttggcagcatgcctggtcgcatcatcaacggcttgaagactgtgggagtgaacaacccagtgttcctattagatgaggttgacaaactgggaaaaagtctacagggtgatccagcagcagctctgcttgaggtgttggatcctgaacaaaaccataacttcacagatcattatctaaatgtggcctttgacctttctcaagttctttttatagctactgccaacaccactgctaccattccagctgccttgttggacagaatggagatcattcaggttccaggttatacacaggaggagaagatagagattgcccataggcacttgatccccaagcagctggaacaacatgggctgactccacagcagattcagataccccaggtcaccactcttgacatcatcaccaggtataccagagaggcaggggttcgttctctggatagaaaacttggggccatttgccgagctgtggccgtgaaggtggcagaaggacagcataaggaagccaagttggaccgttctgatgtgactgagagagaaggttgcagagaacacatcttagaagatgaaaaacctgaatctatcagtgacactactgacttggctctaccacctgaaatgccgattttgattgatttccatgctctgaaagacatccttgggcccccgatgtatgaaatggaggtatctcagcgtttgagtcagccaggagtagcaataggtttggcttggactcccttaggtggagaaatcatgttcgtggaggcgagtcgaatggatggcgagggccagttaactctgaccggccagctcggggacgtgatgaaggagtccgcccacctcgctatcagctggctccgcagcaacgcaaagaagtaccagctgaccaatgcttttggaagttttgatcttcttgacaacacagacatccatctgcacttcccagctggagctgtcacaaaagatggaccatctgctggagttaccatagtaacctgtctcgcctcactttttagtgggcggctggtacgttcagatgtagccatgactggagaaattacactgagaggtcttgttcttccagtgggtggaattaaagacaaagtgctggcggcacacagagcgggactgaagcaagtcattattcctcggagaaatgaaaaagaccttgagggaatcccaggcaacgtacgacaggatttaagttttgtcacagcaagctgcctggatgaggttcttaatgcagcttttgatggtggctttactgtcaagaccagacctggtctgttaaatagcaaactgtaggtccaaatctcaattttttagaattttaagttatgaagtgctcaaaggtactgacacagttgattttattcacaccattaggggtatgcaagatgtccctgttttataaacataatcacaacagtaataaacctcaagtagtggctagtgtttagtatagaaatataagatgttgatttagtaaactgataaaaatcgaattcttgtctttttagtgggatccttactgtccctggaaagatatagcatagtggttctcagcacagtctccagaacagaagcatctgtagtatctggtaacttgttgcaatgtacattcttcaggctccacagcaggccgcctgaatcaaatcctgggaggtggggacagaaatctgggttttaagaagccttccaggtaattctgctgcacactcaagttcaggaacgcaccggtatagaccattaccttagtggatttacctgtagagtttattggatcctgaaaccaatcaattacttagaactaggcaaagatgaaagtatagccaactattcttggctatatatata

SEQ ID NO: 543 - DNA, 1938 bp, Homo sapiens
  CDS (127)..(1806)
atttaaggggcgggttaattaggaacactcgttaactgggggacctctttgaggcttttttccttcttttaaaaaaacattttagataattcttcttttcaagcaaaatcttatttagaaaaaataatgccccaccccccccgaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgat

SEQ ID NO: 544 - DNA, 1193 bp, Homo sapiens
  CDS (47)..(499)
aaggttctgggaagtaggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaagaggaacttgtctctggaggccctggctgtcttccacaaatgactccccaaggcagatgaggaagctggtggatttggctgctggtggggcaacggctgctgaggtcaccaaggctgaatccaagttccatcaccctgtcaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttaaaaaaaaaaaa

SEQ ID NO: 545 - DNA, 2669 bp, Homo sapiens
  CDS (44)..(1621)
ggacggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtccccccaagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactcgccagaacctgtcttcctgaaaaaccaaaaaaccctggagcgcggcccctgttaaaagaaaacaattttgctcccgcggctccgcgaagcgattattttttttgaggccacagaaaatatgtacacgcggcggggttccacggctcgagaagggaaaaccccggtgcgacccccgttcg

SEQ ID NO: 546 - DNA, 3953 bp, Homo sapiens
  CDS (254)..(3349)
cggagtagacgttagccatggaaaccgagagctggcccgggcggggccgcggtgagctcgttattcggccgccgcagcttttctgcctccgcattcgggcactaaccaacctcccggcgggagcgcccagcccgagtttacctgcaaaaatgcggtccctgggatgccttcgcgtcttctcttccctcgggtgacttgagaaactgctgtgttacagaaaagcatgtgactttcagaataatcccgagtgaggatgagtccagatgtgcctctactgaatgattacaagcaggacttctttctgaagcgctttccacagactgttcttggaggccctcgattcaaattaggctattgtgcccctccttacatatatgttaatcaaattattctttttctaatgccatgggtttggggtggagtcggaacacttttataccagttaggcatcctgaaagactattatacagcagcactttcaggtggattaatgctttttactgcatttgtcatccagttcacaagtttatacgccaaaaacaaatcaacaacagtagaaagaatactaaccacggatatcttagcagaggaggatgagcatgaatttaccagttgtactggtgctgagactgtcaaatttctcattcctggcaagaaatatgtagccaatacagtttttcattctattcttgctggattagcgttattagtaatgttcatcatgtctgctggaacagctatagcatcatatttcattccaagcactgttggtgtggttcttttcatgactggatttggtttcttgctgagtctgaacttaagtgatatgggtcacaaaattggaaccaaatctaaggatttacccagtggtccagaaaaacatttttcatggaaggaatgccttttctacatcattatattagtcttggctcttttagaaactagtttgcttcatcactttgctggcttctcacagatttctaaaagcaattcccaggctattgtgggctatggtttgatgatattacttataatactgtggatacttagagaaattcaaagcatatatatcattggaattttccgaaatcccttttatccgaaggatgtgcaaactgtgactgtattctttgagaagcaaactaggctcatgaagattggtattgtcagacggattttgctaactttagtatcaccttttgccatgatagcatttctttcattggacagttccttacaagggctccactcagtgtctgtctgtattggattcacaagagcctttagaatggtatggcagaatacagaaaatgctttattggagacagtcattgtatcaacagtacacttgatctccagtacagacatatggtggaacagaagcctggatacaggactcagactcttactggttggtatcatacgtgatcgtttgattcagttcatctctaaattgcagtttgccgtgactgtgcttttgacatcatggacagagaaaaaacaacgtcgaaaaacaactgccactttatgtatactcaacattgtcttttctccattcgtgttggtcatcatagttttttctacactactctcttctcccttactccctcttttcacccttcctgtgttcttggtggggtttccccgacctattcagagttggccaggagcagcaggcaccacagcctgtgtgtgtgcagatacagtgtactactaccaaatggtgcccaggttgactgctgtactgcagactgcaatggcagctggaagtttaggtctcctcctacctggatctcattacttgggccgttttcaggatcgtttaatgtggataatgattctggaatgtggctatacttactgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaatatggctcctagtcctggtcatatattgagagtttacggtggtgttttgccttggtctgttgctttggactggctcacagaaaagccagaactgtttcaactagcactgaaagcattcaggtatactctgaaactaatgattgataaagcaagtttaggtccaatagaagactttagagaactgattaagtaccttgaagaatatgaacgtgactggtacattggtttggtatctgatgaaaagtggaaggaagcaattttacaagaaaagccatacttgttttctctggggtatgattctaatatgggaatttacactgggagagtgcttagccttcaagaattattgatccaagtgggaaagttaaatcctgaagctgttagaggtcagtgggccaatctttcatgggaattactttatgccacaaacgatgatgaagaacgttatagtatacaagctcatccactacttttaagaaatcttacggtacaagcagcagaacctcccctgggatatccgatttattcttcaaaacctctccacatacatttgtattagagctcattttgactgtaatgtcatcaaatgcaatgtttttattttttcatcctaaaaaagtaactgtgattcttgtaacttgaggacttctccacacccccattcagatgcctgagaacagctaagctccgtaaagttggttctcttagccatcttaatggttctaaaaaacagcaaaaacatctttatgtctaagataaaagaactatttggccaatatttgtgccctctggactttagtaggctttggtaaatgtgagaaaacttttgtagaattattatataatgaattttgtaatgctttcttaaatgtgttataggtgaattgccatacaaagttaacagctatgtaatttttacatacttaaaagataaacatatcagtgttctaagtagtgataatggatcctgttgaaggttaacataatgtgtatatatttgtttgaaatataatttatagtattttcaaatgtgctgatttattttgacatctaatatctgaatgtttttgtatcaagtagtttgttttcatagacttcaattcataaactttaaaaaacttttaataaaatattttccttccttttcaaaaaaaaaaaaa

SEQ ID NO: 547 - DNA, 678 bp, Homo sapiens
  CDS (59)..(556)
ctcaggcaaccgatattgctgattagcctgttaagcaggatattcattgcaactcaccatggctcacaccaggtcatacttcatgctgaactcctgcctgatgttcctgcctcagagcctaggtcaaaaggcccagacagaggtgcccaaggcccggatcaactgcccaaaaagcaccactgcctatcgctcctactgctactactttagtgactaccgtgagacctggagtgatgcctatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagcctggaaatacatggtctagacctgttcagcgattacaaccgggtcaatatttaaaccggacctttctccacctcaactcaaccggacattctcttttcttgcgagttggcct

SEQ ID NO: 548 - DNA, 1069 bp, Homo sapiens
  CDS (134)..(928)
tcggcacgaggcttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatttggccgggcgctggagcggggtccccaggggaaaaacacgcccctccaggggtcaagagcctacggggagaatcgcgggcccctatatgccccgcggcgcagggtacccgaggggggtcttctggccccccagggaggtcataacagagcacccaataggtttgcacacaggcagggtacagacaactaaagaggatttggagagagagacacagagaatgacgtagaaaaaacaaatagtgaggcgattactgccacaacaacgaatagatatgaggaaag

SEQ ID NO: 549 - DNA, 2535 bp, Homo sapiens
  CDS (219)..(2159)
tttcgtgttgggtacccgagagacccggcggtggggaagtcacttcctcccgaagacgctgtttcctagcaaccgccctccgcctctgttattagcccctcctcctcgctcggaccaggaccggctctgcgggcgccgccaggcccagaccaagctactatcagaaggtgaattctaataattagctattttataaaggtaacgagaaaaaatacactatgtctgatgaagtttttagcaccactttggcatatacaaagagtccaaaagttaccaaaagaactactttccaggatgagctaataagagcaattacagctcgctcagccagacaaaggagttctgaatactcagatgactttgacagtgatgagattgtttctttaggtgatttttctgacacttcagcagatgaaaattcagttaataaaaaaatgaatgactttcatatatcagatgatgaagaaaagaatccttcaaaactattgtttttgaaaaccaataaatcaaacggtaacataaccaaagatgagccagtgtgtgccatcaaaaatgaagaggaaatggcacctgatgggtgtgaagacattgttgtaaaatctttctctgaatctcaaaataaggatgaggaatttgaaaaagacaaaataaaaatgaaacctaaacccagaattctttcaattaaaagcacatcttcagcagaaaacaacagccttgacacagatgatcactttaaaccatcaccttggccaaggagtatgttaaaaaagaaaagtcacatggaggagaaggatggactagaagataaagaaactgccctcagtgaagaattggagttacattctgcaccttcttcccttccaacgccgaatggcatacaattagaagctgagaaaaaagcattctctgaaaaccttgatcctgaggattcatgcttaacaagtctagcatcatcatcacttaaacaaattcttggagattctttttcaccaggatctgagggaaacgcatctggaaaagatccaaatgaagaaatcactgaaaaccataattccttgaaatcagatgaaaataaagagaattcattttcagcagaccatgtgactactgcagttgagaaatccaaggaaagtcaagtgactgctgatgaccttgaagaagaaaaggcaaaagcggaactgattatggatgatgacagaacagttgatccactactatctaaatctcagagtatcttaatatctaccagtgcaacagcatcttcaaagaaaacaattgaagatagaaatataaagaataaaaagtcaacaaataatagagcatccagtgcatctgccagattaatgacctctgagtttttgaagaaatctagttctaaaaggagaactccatcgacaactacctcttctcactatttagggactttaaaagtcttggaccaaaaaccttcacagaaacagagcatagaacctgatagagcagataacataagggcagctgtttatcaggagtggttagaaaagaaaaatgtatatttacatgaaatgcacagaataaaaagaattggaagtgaaaacttaaggatccaaaatgaacagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggaatgaaaaaaaggaagcttttttcaagcaaaaaaaaaaaaaaaaaaaaaatgagaaaagaaaggaagaactgaaaagagctgagaaaaaagataaagataaacaagctattaatgaatatgaaaaatggctggaaaataaggaaaaacaagaaagaattgaacgaaaacagaagaaacgtcattcctttcttgaaagtgaggcacttcctccgtggagccctccaagcagaactgtgttcgcaaaagtgttttgataattctagttcttacattatttggttatttatcggtttgccaatattagccatagatttaaaaccattcaattatttatagttagaggaatatattttaattaaatgccagacactcctgctgacaatgaaagaaatactttggaatgtaatcagtgaaagcatttttttgaactgtagataaactgcctcaaacaaagacctaataatcagattgtttttaccattaagatacataagattttatcatgtcctgataattcttatggtggagtgattcatgatctttttcattaagctctgtatgttatttaagtatatttaattccagtaataaaaaggaaatcatctaggtaccataaaaaaaaaaaaa

SEQ ID NO: 550 - DNA, 2645 bp, Homo sapiens
  CDS (183)..(2477)
caactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtggaaaatgcacgatttctttcaccagaagaaaatgtgtgcaatgagatgttggtaaaatcccagtttgttgcttgtatggctacttgtcattcacttacaaaaattgaaggagtgctctctggtgatccacttgatctgaaaatgtttgaggctattggatggattctggaagaagcaactgaagaagaaacagcacttcataatcgaattatgcccacagtggttcgtcctcccaaacaactgcttcctgaatctacccctgcaggaaaccaagaaatggagctgtttgaacttccagctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacagttcctgtcgattttcaaaacgttttggaagacttcactaaacagggcttccgtgtgattgctcttgcacacagaaaattggagtcaaaactgacatggcataaagtacagaatattagcagagatgcaattgagaacaacatggattttatgggattaattataatgcagaacaaattaaagcaagaaacccctgcagtacttgaagatttgcataaagccaacattcgcaccgtcatggtcacaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggctattccggttaaattggtccatgatagcttagaggatcttcaaatgactcgttatcattttgcaatgaatggaaaatcattctcagtgatactggagcattttcaagaccttgttcctaagttgatgttgcatggcaccgtgtttgcccgtatggcacctgatcagaagacacagttgatagaagcattgcaaaatgttgattattttgttgggatgtgtggtgatggcgcaaatgattgtggtgctttgaagagggcacacggaggcatttccttatcggagctcgaagcttcagtggcatctccctttacctctaagactcctagtgtttcctgtgtgccaaaccttatcagggaaggccgtgctgctttaataacttccttctgtgtgtttaaattcatggcattgtacagcattatccagtacttcagtgttactctgctgtattctatcttaagtaacctaggagacttccagtttctcttcattgatctggcaatcattttggtagtggtatttacaatgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagatgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattatttttttgttttttctgtgatttttttatatatttttatattattcatcatgttgtatccagttgcctctgttgaccaggttcttcagatagtgtgtgtaccatatcagtggcgtgtaactatgctcatcattgttcttgtcaatgcctttgtgtctatcacagtggaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaaaaaaaaaa

SEQ ID NO: 551 - DNA, 2896 bp, Homo sapiens
  CDS (66)..(2303)
tttcgtcgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacgtcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggagccttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcagaaaaaaaaaaaaa

SEQ ID NO: 552 - DNA, 1159 bp, Homo sapiens
  CDS (349)..(744)
aagacagtccagagcttttcagccaatttgtctcctactctgtgtaaatatttttccctccgggcaggggagccagggtagagcaaaggagacaagcaggagtggaaggtgaggcgttctcctgcttgtactaagccaggaggctttaagctccagctttaagggttgtgagccccttgggggttcagggaactgcttgcccagggtgcagtgtgagtgtgatgggccaccggggcaagagggaaggtgaccgcccagctctcccacatcccactggatctggcttacaggggggtcggaagcctgtcctcaccgtctcgggggttgtggcccccgccccctccctatatgcacccctggaaccagcaagtcccagacaaggagagcggaggaggaagtcatgggaacgcagcctccagttgtagcaggtttcactattcctatgctggggtacacagtgagagtactcacttttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatctttttctccacccaaaccccttcccacgacaaaaacaagactgcctccctctcttccgggagctggtgacagccttgggcctttcagtcccaaagcggccgatgggagtctccctccgactccagatatgaacagggcccaggcctggagcgtttgctgtgccaggaggcggcagctcttctgggcagagcctgtccccgccttccctcactcttcctcatcctgcttctcttttcctcgcagatgataaaaggaatctggcattctacacctggaccatttgattgttttattttggaattggtgtatatcatgaagccttgctgaactaagttttgtgtgtatatatttaaaaaaaaaatcagtgtttaaataaagacctatgtacttaaaaaaaaaaaaaaaaaaaa

SEQ ID NO: 553 - DNA, 1367 bp, Homo sapiens
  CDS (65)..(622)
tggaggagagaagatggcggaagcggagtgagtgactagatgatttaaggaccatagtacagctatggatactgaaccaaacccgggaacatcttctgtgtcaacaacaaccagcagtaccaccaccaccaccatcaccacttcctcctctcgaatgcagcagccacagatctctgtctacagtggttcagaccgacatgctgtacaggcattgcatcggccccccagctcagctgctcagtaccttcagcaaatgtatgcagcccaacaacagcacttgatgctgcatactgcagctcttcagcagcagcatttaagcagctcccagcttcagagccttgctgctgttcaggcaagtttgtccagcggaagaccatctacatctcccacaggaagtgtcacacagcagtcaagtatgtcccaaacgtctatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatggtaagatatgagctaccaaattttttcagtgtttaaggacttgagagatcaaaatgtttccttgatttgatacaataagaggtatttttaatatttaagaaatgtttaattgtgtgtgtgtgcatgcgggcgtgccttcagctcttgtacatttatgtcatgaaagattctacttttaattaataggtcttcttggtatcaaatagtaattattacattgagaagctaatagagattcagtaacgtaagagtgattattttttaatatcaaattcattgaaaacctttttttcatattttaatatctgtgaaatttggatgcattttataactgatggcatcttggtacttacagtggtccataaaatcattgcctgtttttgtcaacttagatttggtgaaatagagatgttaaaaaaactttgttgttaaagttataatttgtatcctaggattttctgaattctatattggagttccggatagtctcccagatgattcttaactttggtttttcccatctcaaattctgcaaggttatttgtgttcttgtgttcattttgatattttatgaatataggaatgttaatttggttattctgtatttgagtatctacagattttctaatttaattgttgagcttctttaaggaatatagaaattggttgacatgtattttatttgatgtctttacaagaagctagacaaaagcattgtccctaatatatatttatattcttttttgtccagtggactgaatatatatctggatctcca

SEQ ID NO: 554 - DNA, 2229 bp, Homo sapiens
  CDS (150)..(1694)
attgctgacacacgtactggctgaactggtacatggcgggggggaccacctccccagccttctgtagggctgcctggctcttgtcgctgggccccagcagctcctggtcgtacaccaggtagacggcgcccccagccacacttcccttgatgaggaacctcatcagcgacacgaaatcgtcgacgatttcgtcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagagatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcactgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttggtagctgtggataataatataacacactgaaagaacaaatataagaatgataacactggaagatatattcttatctaattactagcggattaaatactcacctgtgctctgattatatctacatcctttgtaaatgtcgatttgattttaaagtttttttttaatgcgactattttttatctgaaaagtaatccattacactttgctatgttttatacatttcaaaagggagggaaattccaaagcctgaataatggaatggatacatttcaatttagcatatattctggctttagatcccggcatg

SEQ ID NO: 555 - DNA, 3425 bp, Homo sapiens
  CDS (165)..(3422)
ggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagccagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccagcagagtgggagaagtctggaggacatcatggtttccgcgccccaaactccaacccatggtgctctggctaaattccagacagagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggcagccctgaagcagcttcctaggaacaaggtccccaacatggcggtgatgatcaagtccctgactcggagcacaatggacgccagtgtggttttcaaggaccccacgggagagatgcaggggacggtgcacaggttgctgctggagacgtgccagaatgagctgaagcctggctcagtgctgctgctgaagcagattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagccctgcccatctccatgactgacctttttgcgcaccctggaccttgccaacccaagatgctcgctctagagatgaagcaggagtggctggaatgggaggaccggcggcgggcggctgcccagcagtgccggagccgcaggtgcccgtcaagtccccgggcccgactcactaggcctcaccgttcctgccgagacccagctgtccaccaagccctcttctccggcaacctgcagcaggtccaagccctgttccaagatgaagaggccgccaacatgattgtggagactgtgagcaaccagctggcctggtcggctgaacaggggttctgggtgctgacccccaagaccaagcagacggcacccctcgccatcgctacagcccgaggctacacagactgtgctcgacacctgatccggcagggagctgagctggatgcccgtgtcgggggtcgcgctgccttgcatgaggcctgtgcccgagcccagtttgactgtgtgcggctgctgctgaccttcggagccaaggctaatgtgctgactgaggagggcacgactcctttgcacctctgcacgatccccgagtccttgcagtgcgccaagttgctgctggaagcaggagcgacggtgaacctggcagcaggcgagagccaggagacgcccctgcacgtggcggcggcgcgcggcctggagcaacatgtggctctgtacctggagcatggcgccgacgtgggcctgcgcaccagccagggcgagactgcgctgaacacggcgtgcgctggggccgagggcccaggtagctgcaggcgacaccaggctgcggcgcgccggctcctggaggctggagctgatgcccgggcggccgggcgcaagcgccacacgccgctgcacaacgcttgtgccaacggctgcgggggcctggccgagctgctgctgcgttacggggcccgcgctgaggtccccaatggggcgggccacacgcccatggactgtgcgctgcaggccgtccaggactcccccaactgggagcctgaagtccttttcgccgcactgctggactacggggcgcagccagtgcgccctgagatgctgaaacactgcgccaacttccctcgggccctggaagtcctgcttaatgcctatccttgtgtcccatcctgtgagacctgggtggaggcggtgctcccagagctgtggaaggagcacgaagccttctacagctcggccctgtgcatggtgaaccagccaaggcagctgcagcacctggcccgactagctgtgcgcgctcggttgggaagccgctgccggcagggtgccacccggctgccactgcccccgctcctcagggactacctgctgctgcgtgtggaggggtgcatccagtga

SEQ ID NO: 556 - DNA, 5075 bp, Homo sapiens
  CDS (253)..(3750)
cgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctccccggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccccaacggggacgtggaacgagtcaagaggctggtgacgcctgagaaggtgaacagccgcgacacggcgggcaggaaaatccacccgctgcacttcgccgcaggttttgggcggaaagacgtagttgaatatttgcttcaaaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaagggaccaacacaaattccaacaggacgggtcgattttatccaagaatattttcccggtccattaacctgggtaaaggcggataatagccactcaactcggggtaactaccggacttaaagtcttgtgtataggcccctaaggcctaaaggaacggctgaaaaagagaaatagaccaggatccccaacattaaccccggaaacgcgggggacaattagacacacagcaactgctaacacaagcccacagcgatacacaacatcaaagcagctacacacacacataataagacaacgcagtgtctcgcttcccttctcttcttcacttccccgtctcaagaga

SEQ ID NO: 557 - DNA, 4988 bp, Homo sapiens
  CDS (161)..(1363)
tttcgtgcaaaaagtgggttacacgacagcacagcctcgctgctggagatgaaaaaccaataatcccagaaaacggcgcatagggtaggctgggccagccgaggattatgtgaaggttcgttgggaccctccggaggccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggccctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcaaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttc

SEQ ID NO: 558 - DNA, 5060 bp, Homo sapiens
  CDS (161)..(1435)
tttcgtgcaaaaagtgggttacacgacagcacagcctcgctgctggagatgaaaaaccaataatcccagaaaacggcgcatagggtaggctgggccagccgaggattatgtgaaggttcgttgggaccctccggaggccagtggggtactgcaaagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgtgagtatccagttaggacaggatcctcaagtcttagtgcatcagggagcaggacagggaagatggatgtgggttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgacaacatcaacttgctgcttactgaggaggaaatgtatagcctcacggagacctttcagcggtgtaaagtcatccctgattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcagcagcatcagccatgtgggtcccatcgcagatagcagcccagccagcagcagcagcaagagtcaggacaagaccctgctgcccacagagcaggagtccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggccctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcaaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttc

SEQ ID NO: 559 - DNA, 1883 bp, Homo sapiens
  CDS (26)..(1573)
gtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttggctccaaatgaccacttgctttatagcaatcggtctcagatttatttcaccttggagtctcatgagaatgcactgcatgatgcagaaatagcatgtaagctccgcccgatgggttttaaggacaatctggagctcccacattgttctagtcaggaggaagcagcagccaggggagatggcagcagtctgatggacccagctaaagtgaagggggatggtcagcagcaccacatgaaagaccaggaagaagaggaggagaagtgggatgctacctctccaaaagctgcttccagcaagactggaaaatgccaggaaaagaaaaggaaacattgccagattgaatcccaagaagaaacggggatgcctaataaagcctccaagcaagatcctcccactgatcagggggacaaacctgctctcagtttaccacttgcatctttcgacgcatctgaccttgaatgcgctctatgtatgagattattctatgagccagtcacaacaccttgcgggcatactttttgcttaaaatgcctagaaagatgcctagatcacaacgcaaagtgtccattgtgcaaagacggtctttcacagtgcttggcatcaagaaaatacagcaaaaatgtaataatggaggagctcatagctaaattccttccagaagaactgaaggaacgaaggaagctttatgaagaggaaatggaagaactttctaaccttaataagaatgtgcctattttcgtgtgtactatggcctatcccaccgttccttgtcccctgcacatctttgagccttgttaccgcctgatgattcgtagatgcattgagacaggcacgagacagtttggcatgtgccttggagatcctgtcaaagggtttgcagaatatggctgcatcctagagatcagaaatgttcaattctttgctgatggccgctcagtggttgacagcataggcaagaggcgcttcagggtgctccatcagagccagcgggatggctacaacacagccgacattgaatacattgaagaccaaaaggttcagggagaggattgtgctgagctcatgggattacataactgtgtctatcagcaagcatcattgtggtttcattcgctcaaattatccctaaagaatcggatactcaatcactttggtcccatgccggagaaagacgccgatcctcagatgaacccgaatggcccagcctggtgctggtggatgttagcagttcttcccttggaaagccgagctcagctccccttcctagcaatgaggtccttaaaggacagactgaatggtattcgacgagtcctggccttcatatcccgaaaccaaaactagtgagtggattgccgaagaggagctcccaccttccccactgccgtcggggggagtcttcttgtaaatatatctaattgcaataatatcttaacagaagggggtgtcaaacagaggcatcagcctgctgttgatcacagagagaaattgagtagaaagaccaaaagaatgtgacctatttgaaactttctgtcttaagatgcttcttgacatgctgcataactacataaacagcagaggtgtttaagagcccagaaaaacataatttgattttaacattaaaatttccaaaagtttaaaaaaaaaaaaa

SEQ ID NO: 560 - DNA, 4059 bp, Homo sapiens
  CDS (268)..(4056)
cagaatagtagttcacaaccatatttttcgaagacagcgaaatgcataagcattgagagaacttgttctctatggttgttactcccctatgattctgtaagggtaacaccgtccatgccagcaagcgctcggagacagtgagcgtggtagtcaatcacccgcctgtctcctcagtcatggcagccttcctggagaaccaggcgggacttgtgggcatccttcactgctctgtggtcagtgagcccctggccacactggtgctgtcacatgggggtcatatcctggcctccgcctccggggacagtgatcacagcccacgcttcagtggtacctctggtcccaactccctgcgcctggagatccgagacactggaggaagctgacagtggggagtacaagtgctcagccgccaactcccttggaaatgcaccctccaccctggacttccatgccaatgccgcccgtctcctcatcagcccggcagccgaggtggtggaaggacaggcagtgacactgagctgcagaagcggcgtaagccccacacctgatgcccgcttctcctggtacctgaatggagccctgcttcacgagggtcccggcagcagcctcctgctccccgcggcctccagcactgacgccggctcataccactgccgggcccgggacggccacagtgccagtggcccctcttcgccagctgttctcactgtgctctacccccctcgacaaccaacattcaccaccaggctggaccttgatgccgctggggccggggctggacggcgaggcctccttttgtgccgcgtggacagcgacccccccgccaggctgcagctgctccacaaggaccgtgttgtggccacttccctgccatcagggggtggctgcagcacctgtgggggctgttccccacgcatgaaggtcaccaaagcccccaacttgctgcgtgtggagattcacaaccctttgctggaagaggagggcttgtacctctgtgaggccagcaatgccctgggcaacgcctccacctcagccaccttcaatggccaggccactgtcctggccattgcaccatcacacacacttcaggagggcacagaagccaacttgacttgcaacgtgagccgggaagctgctggcagccctgctaacttctcctggttccgaaatggggtgctgtgggcccagggtcccctggagaccgtgacactgctgcccgtggccagaactgatgctgccctttacgcctgccgcatcctgactgaggctggtgcccagctctccactcccgtgctcctgagtgtactctatcccccggaccgtccaaagctgtcagccctcctagacatgggccagggccacatggctctgttcatctgcactgtggacagccgccccctggccttgctggccttgttccatggggagcacctcctggccaccagcctgggtccccaggtcccatcccatggtcggttccaggctaaggctgaggccaactccctgaagttagaggtccgagaactgggccttggggactctggcagctaccgctgtgaggccacaaatgttcttggatcatccaacacctcactcttcttccaggtccgaggagcctgggtccaggtgtcaccatcacctgagctccaagagggccaggctgtggtcctgagctgccaggtacccacaggagtcccagaggggacctcatatcgttggtatcgggatggccagcccctccaggagtcgacctcggccacgctccgctttgcagccataactttgacacaagctggggcctatcattgccaagcccaggccccaggctcagccaccacgagcctagctgcacccatcagcctccacgtgtcctatgccccacgccacgtcacactcactaccctgatggacacaggccctggacgactgggcctcctcctgtgccgtgtggacagtgaccctccggcccagctgcggctgctccacggggatcgccttgtggcctccaccctacaaggtgtggggggacccgaaggcagctctcccaggctgcatgtggctgtggcccccaacacactgcgtctggagatccacggggctatgctggaggatgagggtgtctatatctgtgaggcctccaacaccctgggccaggcctcggcctcagctgacttcgacgctcaagctgtgaatgtgcaggtgtggcccggggctaccgtgcgggaggggcagctggtgaacctgacctgccttgtgtggaccactcacccggcccagctcacctacacatggtaccaggatgggcagcagcgcctggatgcccactccatccccctgcccaacgtcacagtcagggatgccacctcctaccgctgcggtgtgggcccccctggtcgggcaccccgcctctccagacctatcaccttgtacgtcctctacgcgccccgcaacctgcgcctgacctacctcctggagagccatggcgggcagctggccctggtactgtgcactgtggacagccgcccgcccgcccagctggccctcagccacgccggtcgcctcttggcctcctcgacagcagcctctgtccccaacaccctgcgcctggagctgcgagggccacagcccagggatgagggtttctacagctgctctgcccgcagccctctgggccaggccaacacgtccctggagctgcggctggagggtgtgcgggtgatcctggctccggaggctgccgtgcctgaaggtgcccccatcacagtgacctgtgcggaccctgctgcccacgcacccacactctatacttggtaccacaacggtcgttggctgcaggagggtccagctgcctcactctcattcctggtggccacgcgggctcatgcaggcgcctactcttgccaggcccaggatgcccagggcacccgcagctcccgtcctgctgccctgcaagtcctctatgcccctcaggacgctgtcctgtcctccttccgggactccagggccagatccatggctgtgatacagtgcactgtggacagtgagccacctgctgagctggccctatctcatgatggcaaggtgctggccacgagcagcggggtccacagcttggcatcagggacaggccatgtccaggtggcccgaaacgccctacggctgcaggtgcaagatgtgcctgcaggtgatgacacctatgtttgcacagcccaaaacttgctgggctcaatcagcaccatcgggcggttgcaggtagaaggtgcacgcgtggtggcagagcctggcctggacgtgcctgagggcgctgccctgaacctcagctgccgcctcctgggtggccctgggcctgtgggcaactccacctttgcatggttctggaatgaccggcggctgcacgcggagcctgtgcccactctcgccttcacccacgtggctcgtgctcaagctgggatgtaccactgcctggctgagctccccactggggctgctgcctctgctccagtcatgctccgtgtgctctaccctcccaagacgcccaccatgatggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagaaggaggcgtgtttgtaagcagagcatgggcgagaattcggtggagatggcttttcagaaagagaccacgcagctcattgatcctgatgcagccacatgtgagacctcaacctgtgccccacccctgggctga

SEQ ID NO: 561 - DNA, 316 bp, Homo sapiens
  CDS (113)..(262)
tttagcaagaaaattcccaggcctgagaagaaatatttcaaaatgcccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatgaggcaccttcggccgttcagaagtggcctgaacagaatgctggaacccaggctggactcggacacactaaggttttgattttgaatttcagccttattagaagatctaacctaagagtaagttatccac

SEQ ID NO: 562 - DNA, 1453 bp, Homo sapiens
  CDS (840)..(1070)
ggggacctcaaacagtccaaaggagaagcctggggtggtcaggggtggtcagggacaggcttaggggcaccttgaaagttcaggctgactggggctaggggaacatgtgggtaacaggttaaaggggggggggctggaaaatgcagacaccaaagacccttcaatatgaggccaagaaaggaaggttcagaacagggaaaaggaaggcttccatgatcctggccacaatcctgtgaattaggttttagtattctcagtctgaagataaggaattattgatacaattcagaaaggtagagcaacttgctttaggtcacacagtgaatgagtagtgcagacaggattcaagtctgcccccttgattctgaagccaaagctctttttcctgcttggtgcaggtgagtgggaggcatggggtggatgagaagcctaggcagaggcttttcctgcatccctcctcagtttccctattcacagatgccggcctccctgtctacctgtatgaatttgagcaccacgctcgtggaataatcgtcaaaccccgcactgatggggcagaccatggggatgagatgtacttcctctttgggggccccttcgccacaggtgcaaaggtcccacctgataccccaactgggtgtccagtctcccacctctggatgcagacccacccctccattggctggccacagggagctcaccagttcctaatctgttatgctctcccaaatgaaagtcttctgctccggaagcagcagaagcagcaggagtagggtgggaggtcagtgtcccctgctctgtccgaaatcccacatcccattctgcccccaggcctttccatgggtaaggagaaggcacttagcctccagatgatgaaatactgggccaactttgcccgcacaggaaaccccaatgatgggaatctgccctgctggccacgctacaacaaggatgaaaagtacctgcagctggattttaccacaagagtgggcatgaagctcaaggagaagaagatggctttttggatgagtctgtaccagtctcaaagacctgagaagcagaggcaattctaagggtggctatgcaggaaggagccaaagaggggtttgcccccaccatccaggccctggggagactagccatggacatacctggggacaagagttctacccaccccagtttagaactgcaggagctccctgctgcctccaggccaaagctagagcttttgcctgttgtgtgggacctgcactgccctttccagcctgacatcccatgatgcccctctacttcactgttgacatccagttaggccaggccctgtcaacaccacactgtgctcagctctccagcctcaggacaacctctttttttcccttcttcaaatcctcccacccttcaatgtctccttgtgactccttcttagggaggtcgaccgggaattccggagcgg

SEQ ID NO: 563 - DNA, 2797 bp, Homo sapiens
  CDS (128)..(2683)
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctggtaggtcagggagcatctgatctcactaatactgcatctgatttctctagcgatatcaggttgtcttctgagctctcaggcagcatcaatgatttgaacactttagacccaaatctactgtttgatccaggtcgtcagcagggacaagatgatgaagctacactggaagaattaaagaatgacccattatttcaacaaatttgcagtgaatccatgaattctatgacttcatcaggttttgaatggatagaaagcaaggaccatcctactgttgaaatgttgggttaaattgtgttttataacatgtagcacactgtatctaaagacatatgtattgtatttgtcttaatggaagtgcctcccgcagcagaaatactattaagttgtgaaccaaatttt

SEQ ID NO: 564 - DNA, 3537 bp, Homo sapiens
  CDS (434)..(2785)
tttcgtgcggctgagtgacggacggtggaggcccagagcccgggcctgaagggggggacaaacctgggtgcccgcaggagcccggcagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctgtcagctatggaggggttgatcctaacatgtgggaaccccaggagcttggtgctgtgagaagccatctttccgacttcaaaaaacaccgagctgctaaaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgccctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcactttaagttcttttttgtctctttcaggaagttaagctcccagtgcagggtatcaatgtgaatctggtcctgagct

SEQ ID NO: 565 - DNA, 4223 bp, Homo sapiens
  CDS (230)..(2632)
ttgacgtgtggaagcagttcttggggatgtgactactgccacggtgacaattctagaccaggaggcagcagggagcctcatattgccagcaccacccattgtggtcacacttgctgactatgaccatgtggaagaagttaccaaggaaggagtcaagaaatccccctccccaggctacccactggtctgtgtcaccccctgcgaccctcatttccccagatacgctgtcatgaaggagcgctgcagtgaggccggcatcaaccagacatctgtgcagttcagctgggaagtggctgcccccactgatggcaatggggcccggtctccctttgaaaccatcactgacaacacaccattcaccagtgtcaaccacatggtcctggacagcatttacttcagccggcggttccatgtgcgttgtgtggccaaggctgtggacaaggtgggccatgtggggacccccttaaggagcaacattgttaccattggaacagacagtgctatctgccacacaccagtggtggctgggacatccagaggcttccaggctcagtccttcatcgcaaccttgaaatacctggatgtcaaacataaggagcatccgaacagaatccacatttcggtgcagatcccacaccaggatggaatgctgccccttatctccaccatgccgttgcacaacttacattttctactgtctgagtccatctacagacaccagcacgtctgctccaatttagttaccacctatgacctgagaggcatctcagaggcagggttcctggatgatgtggtctatgatagcactgccctggggcctggctacgatcgccccttccagtttgaccccagcgtgcgagagccgaagaccatccagctctacaaacacctgaacctgaagagctgcgtgtggacctttgatgcttattatgacatgactgagctgattgacgtctgtgggggctctgtaaccgctgacttccaggtgagggactctgcccagtccttcttgacagtgcacgtgcctctatatgtgtcctacatctatgtgacagcccccaggggctgggcctccttggagcaccacaccgagatggagttttctttcttctatgacactgttctctggagaacaggaatccagacagacagcgtgctctctgcaaggcttcagataataagaatctacattcgagaggatggccgtcttgtcattgaattcaagacccatgccaaattcagaggacagtttgtgatggagcatcacactctcccagaagtgaaatctttcgtattgactccagaccacctaggaggaattgaatttgacttgcagctattatggagcgctcagacttttgattctccacatcaactctggagagccacaagctcttataacaggaaggactactcaggagagtacaccatctacctgatcccttgcacagtgcagcccacacagccatgggttgacccaggagagaagcctttggcctgcactgcacatgccccagaaagattcctgatacccattgcattccagcagaccaaccgccctgtgccagttgtgtattcacttaacactgaatttcagctctgcaataatgagaaggtgttcctaatggatcccaatacatctgatatgtcactagcagaaatggattacaaaggagccttttcaaaaggtcaaatcctttatggccgagtactttggaatccagaacaaaatcttaattctgcttacaaactccagctggagaaagtctatctttgtacgggcaaggatggttatgtgcctttctttgatcccacggggacaatctacaatgaagggccccagtatggatgcattcagccaaacaaacacctaaaacacagattcctgctgttggaccgcaatcagccagaggtaactgataagtacttccatgatgtgccttttgaggctcactttgcctctgagttgcctgatttccatgtggtcagtaacatgccaggtgtggatggatttactctaaaagtagatgcactctataaggtggaagcaggacaccagtggtatctccaggtcatctacatcattggccctgacaccatctcagggccccgggtccagcgctctctcacagctccactcagacgcaaccgaagggacctggtagagcccgatggccagctgatccttgatgattccctcatctatgacaatgaaggagaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacaccctgattccattaaaaattctgctaatcgacacaacacatacatttgctcatgattttcacttgacagcgtatgctccttggcctctaattgtactttgcttttccagagccctttttacctggggatttcagtgtgcttaagtaaaatcctctgaaaaccacgggagcctctgccccctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttctgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttc

SEQ ID NO: 566 - DNA, 1939 bp, Homo sapiens
  CDS (145)..(678)
tttcgtccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaaaaaaaaaaaa

SEQ ID NO: 567 - DNA, 2064 bp, Homo sapiens
  CDS (49)..(1863)
gaatcaccttgtgggttctcttgcaagaatagtaaccagtttggaataatgatgtatcataacaaccgactcataaaatcttttgagaaggtggggtgccaggtgaagccaactcgtggagaaggtgtaggagtaattggagtcattgagtgcaatttcctaaaacctgcctacaacaaacaagactttgagtataccaaggagtaccggctaacaataaatgcccttgcccagaagctcaatgcttactggaaggaaaaaacatctcaagataattttgagacctcaactgtagccaggccaataccgaaggttcctgaccagacatgggttcagtgtgatgagtgtcttaaatggagaaagcttcctgggaagattgatccatccatgttacctgcaagatggttttgttattataattcccatccaaagtacaggagatgctctgttccagaggaacaagaactcactgatgaagacctgtgcttgagcaaagctaagaaacaagaacaaactgttgaggagaagaagaagatgcctatggaaaatgagaaccaccaggtattcagtaatccaccaaagatccttactgttcaagaaatggctggattgaataacaagacaattggatatgagggaattcatagccctagtgtgcttccttctggtggagaagaaagcagatcaccatctcttcaacttaagcctctggattccagtgttttacagttttccagtaagtacaaatggatcctaggtgaagaaccggtggagaaacgaagaaggctccagaatgagatgacaacaccttctctagattattccatgcctgctccttacaggagggtagaagcacctgttgcctacccagaaggggagaacagccatgataaatcgagttctgagagaagtacaccaccataccttttcccagaatacccagaagcaagcaagaatacaggtcagaatagggaggtttcaattctgtatccaggggccaaagaccaacgccaggggtccctgcttcctgaagaattagaagatcagatgccaagattggtggcagaagaatctaacagaggtagcacaaccataaacaaagaagaagtcaacaagggaccttttgtagctgttgtgggtgttgccaaaggtgttagagattcaggagctcccattcagctgatcccttttaacagagaggagcttgctgagagacgaaaagcagttgaatcctggaacccagtgccttattctgtggcctctgctgcaatccctgctgcagccattggggagaaagcaagaggctatgaggagagcgaaggtcataatacaccaaagttgaagaaccagagagagctggaagaattgaagagaaccacagaaaaattggaacgtgttttggctgaaaggaatttgttccagcaaaaggtggaggagctggaacaggagaggaatcactggcagtctgaattcaagaaagtccaacatgaattggtgatctacagtacccaggaggcggaaggcttgtactggagcaagaaacacatgggttatcgccaagctgaattccagattctgaaagctgagctggaaagaaccaaagaggaaaagcaagagttaaaagagaaactgaaggaaacagagacacacctggaaatgctgcagaaggctcaggtctcctaccggaccccagagggagatgacctagaaagggctttggcaaagcttacgcggctacgtatccacgtcagctatctccttacttctgtcctccctcacttggagcttcgtgagatcgggtatgactcagaacaagtggatgggatcctgtacacggtgctggaggcaaatcacatactggattgagcaccagactgtatacccttctcttctcttacccttttttgcccttacagatacttccctctgcttagaatgtccttcctctattgtccacctagaaaacttttccttcatatttaatatcaaatataatctgctttgtgaagccttccctgactcccttaagcatatttaaaggtcgagcggccgcgaatttagtag

SEQ ID NO: 568 - DNA, 6244 bp, Homo sapiens
  CDS (100)..(3516)
cgtcgcggccccgccggcccgactctcaagcctcagctcccaggctaggctgtggccgccggtggcctggggagagtgcggcgccatgcctcgggcttaatgcgcccccccctacttctcccagtcttcagtcttaagtcgttagcctcctccctccgctttcagcagtggtctttcagctctcttcttgtgcgctgttgtcgagccccgaccagccccttccagacccagtcatcatgtcccagtccgggaataccggcctccggcggcgccccagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttcaaaatagcttcataaagtcaggtccttctgtacctcccttagtgaatccacctctgcctacaacttttcaaccaggagctcctcatgggccccctccagctggaggcccacccccagtgagggccctcacgcccctgacatcatcatatagagatgtaccccagcccttatttaattcagctgtcaaccaagaaggtattacatcaaataccaataacggatctatggtggtccacagtagttacgacgagattgaaggaggtggcttattggcaacaccacagcttactaacaagaatcccaaaatgagccgaagtgttggatattcatatccctccttaccacctggttatcagaacacaacaccacctggtgcaactggagtaccaccctcttccttgaattacccaagtgggccacaagcctttactcagactcccttaggtgctaatcatttaaccacaagcatgagtggattaagtctacaaccagagggtctaagagttgtcaatcttcttcaagaaagaaacatgcttccgtcaacacctttgaagcctccagttccaaatttgcatgaagacatccagaaactcaactgtaacccagagttatttcgatgcacgctgactagcattcctcagacgcaggccttattgaataaagccaaacttcctttggggctgctgcttcatcctttcaaagacttagtgcaattgcctgtggttacctccagtacaattgtgagatgccgttcatgcaggacgtacatcaatcctttcgtcagctttcttgatcaaaggagatggaagtgtaacttatgttatcgagtcaatgatgttcctgaagaattcttgtacaaccctttgaccagagtttatggagaacctcacagaagaccagaagttcaaaatgctactattgagtttatggctccttcagaatacatgttacgaccacctcagcctccagtgtatctctttgtatttgatgtgtctcacaatgcagtcgaaactggatacttgaattcagtttgccagagtttgttagacaatctggatttgcttcctggcaacactagaacaaaaattggcttcataacatttgacagtacaatccatttctacggtcttcaggaaagtctctctcaacctcagatgctaatagtttcagatattgaagatgtttttatacctatgccagagaacttattagtaaacttaaatgaaagtaaagagctcgtgcaagatttactgaaaactttgccacaaatgtttaccaagactctggagacccagagtgccttgggtcctgcactgcaggctgcctttaagctgatgtctccaactggtggtcgaatgtctgtctttcaaacacaactcccaactcttggagtgggagccctgaaaccacgagaggaaccaaaccacaggtcatctgctaaggatatacacatgacaccatccactgacttctataagaaattagccttggactgttctggtcagcaagttgctgttgacttattccttctcagtggacagtattctgatttggcttctctgggttgtatttctcggtattcagcaggtagtgtctattactatccctcttaccatcatcagcacaacccagtccaagtacagaaattacagaaggaactacagagataccttactcggaagattggctttgaggcagtcatgaggattcggtgcaccaaaggtctttccattcatactttccatggaaacttctttgttaggtcaaccgacttactgtctttgcctaacgtcaacccagacgctgggtatgcagtacagatgtcagtggaagagagtcttactgacactcagttggtttcttttcagtcagcactcttgtatacatccagcaaaggcgaaagaagaattcgtgttcatactttgtgtttgccagtagtttcgactctgaatgatgtctttcttggagctgatgttcaagcaatttcagggttattggccaatatggctgttgacagatctatgactgccagtctgagtgacgctcgggatgctctagtgaatgcagtcattgactccctttcagcttaccgttcttcagtcttaagtaaccagcagcctggactcatggttcctttttctttgcggcttttcccactttttgtgttggctctccttaaacagaaatcattccagactgggacaaatgcacgtctagatgaacgcatttttgctatgtgtcaagtgaaaaaccagcccttggtttaccttatgctcacaactcatcccagtttgtatagagttgacaatctctcagatgagggagcactcaacatcagtgatagaaccatacctcagccccccattcttcagctttcagtggagaagctgagcagagatggagctttcctcatggatgcaggctctgtactgatgctttgggttggaaaaaattgtacacagaattttctcagccaagttctaggagttcaaaactatgcatcaattccacagcctatgacagaccttccagaacttgatacaccagaatctgccagaataatagctttcatctcttggcttagagagcagagaccatttttcccaatactttatgtaataagggatgagagtccaatgaaagcaaacttccttcaaaacatgatagaagacagaacagaatctgcattatcatattatgaattcctgttgcatatacagcaacaagtgaataaatgaatgaatgaagaaatttgacttatttttaaggaatgtcacgatagtgcagaatacctggaaatgtgtaataccttctttttctattatgtttgtggactaatgtgatgattgagatgttctcactgtgatttcaacaacctatagcaaataaaagaccacagcagagaatcaaacatgcaactctgaaatactgtatttttcaaatcagaatatagctacgtatgattggatacttttttcttgccaattatgtttgagttgttatggattaaaataagaatattgcagaggcaaagtacattttgtaaaataaagatttctgtgttctacatgtatatttctcatttttaatttttctgaatctttggctgctacatttaaaacctcacaaacctaagtgttgcagggaagttacaaattgattggtagtgatgtttttaaaataaaaacaatggaaagtaaatataatgtaggaaaactagaattcattccccacacgtgtcttttttttttctttgttaagggaaaggatcatgttgactaaaactaaactaattctagtatagcttgagaaaaatatgaagaaacacattcaagctttaaaatctgtcagtattctttatgcttgaagaacaaagtcactttgatttgaagtgagaactatcattaggtggttttctgatttcctgatgaagagttggacatactgtcttaatctatagtgaaaagaatttgagctgtcttcataaacactgggactagcaatgataatagggagatacgaaactttaattatcttgatcctttaagtggattttatttggtgcatttctgctctgggtatataataaaagtgggggtttttggtgaaatgagtgaagaaatgaaaggtttctaaagtgctatccaaatacatcagtaacatttttctaaggagtttaattgttaaattggaagtcattcataagaaatatttatgcttgaatatgaaaatctatgaaagcataaatgctgctgtttgatttggtggatattaagattatacacatccaacatattaaagttatgaaagaaacttgacttctgaaaatccttaagagactgctttcttgattcagctagagaaatattatagtcaaaactattgagtgaattttgtttacaaataggtaaattatacatttgtatatttaaagtgctgtgacatagtatctttaagagtttggctcagttttcacagattcattttgtcttaagaatttcttaaatatgttcatgtataatacttgatcaaaatatttttgggttttttgttttgttttaatgggttagaaaatgtttacaatcttggtcttatatgatcaccaatggaatagtaacttccaggtttatatcaatatgagctgactttaactgagttgtttgggatagggaagaagcagtccctctacagtatacaactactgcttgccagctggatcaaaataatcatgttttatgaaaatatctcccttaagcagtgttaaggttggtttgcagtgtgtaagtggcacattgaactggaagttttcttgaaagctgcttcatctattaagaagcaattttcaaattgtagcgaattatattatcccctcttttaaagaaacagtcgttatatgctgatgtttcttaaaataactaaaatgttcctcttaatgtgattttaaatggagttatttgtaggtcctttcttagtagtaaagaatcttctagagggaaacatttgtgcttttagggataatcttccttgtgcctcactacatccctaagtgggtatgactcttgttattaccacatgcttttttagtatatttcacaaatttacttttaaatattattttagatacggtgtaacatgtgcaattcagaataattttataacaggtcatgaaaaacataactttagttaggattcacaatatttgttctccacataatgagagaatgaatgagcctttggagatactgatataaggcaattattttttgcaatgttgaatgtgttttttagtttgattctttttttttcccccaatagggcactacctgccatatcatcttgtattactttttgatgtaaagcgactaatatttacactatgccatattttttttaattatagttgtaaattatgaaagatccttgaattttctacagatctacaactactaatgtaacagacaagggcaatcttggtatttaaatctgagcatggcagttctaccataaaaagtactctatttttctaatttctaggatttttaaaataacatttctgtaagtctgacatactaatagtcactcaagcagtaccatttattttagtttgcatatattttcactgtttttaatttaatgtattgagtctaatagactgttttgcaataattagaataaagatttatttcttctaatcaaagatgcataacagctattatctaggggaccaccaaatgtgatttcaaaattttgttaactattacaaatgtaatccttatatagaaattttaattttgtaaagtagtgtataatattgtaatattaaattcttgttcttaaattcaaatatgtattgatcttcaatgtgctgtgttaaatcttgcttctctgaaaagttggagacaagatttgtcttcctttttacagtttgtaattttcactgttttattcctgttaaaaaaaaaa

SEQ ID NO: 569 - DNA, 478 bp, Homo sapiens
  CDS (15)..(239)
attattgaaagcctatgaatttaaaaccaggtttaccatgtaatttgtttttaaatttatgtatactagcctggcctttctccaagcaaattattgaactattagaatatgttagttatcatccttgggtcttagtatatagggaatacagaaacatcagcattgtatacacatattttcactttaactcaagaattccaggaggtaatttgttgatattacaatttttaacacatttatgattctgtgataatattattcaattgcatatatttcagaggaaagtaccagtcagtaaagaaaaatgccaactaaacatgaaactattgatcaatacttatatacctttaatttttcctatttgaaaagccaaccacttaacacattactcatagcacctaagacagtgccttgcatactggagtcatctattattattgtttaattagaatattaaaccctaccctttaactcagca

SEQ ID NO: 570 - DNA, 1330 bp, Homo sapiens
  CDS (269)..(1327)
ggttccgtcatgattacattttgcgaactatagtataaatcactctaatgatattgactcttctgtgttctgtttttatatatttccctagctttgcttgtatttacttgttgcatgtgtgtaagccctgagttttataggtttgatttgtggatctgttgtgcggttgagccctcattcattcacctgcttctctgcagttggacacacaagcaattgcctttgcacgaacagggacaatcttaatttctggttaagatgaaaaaatatggttgcagacacattaaaacttctgtctccactgatgacaagatacttctttctgcttttttattctactgattcttcagacctcaatgaaaatcaacatcccctagattttgatgaaatggcttttggaaaagtaaaatcagggattagcttcctcattcagactggagttgggatcctgggaaattcctttctcctttgtttttataacttaattttgttcactggacacaagctgagacccacggacttgattctcagccaactggccttggctaactccatggtccttttctttaaagggatacctcagacaatggcagcttttggattgaaatatttgctgaatgacactggatgtaagtttgtcttttattatcacagggtgggcacaagagtttccctcagcaccatctgccttctcaatggattccaagccattaagctcaaccccagtatatgcaggtggatggagatcaagattagatccccaaggtttattgacttctgttgtctcctctgctgggccccccatgtcttgatgaatgcatctgttcttctattagtgaatggcccactgaatagcaaaaacagtagtgcaaaaaacaattatggatactgttcttacaaagcatcaaagagatttagctcattacatgcagtcttatatttttcccctgattttatgagtttgggcttcatggtctgggccagtggctccatggtcttcttcctctacagacacaagcagcaagtccaacacaatcacagcaacagactctcctgcagaccttcccaggaagccagagccacacacaccatcatggtcctggtgagctccttttttgttttctattcagtccatagttttctgacaatttggacaactgtagttgcaaacccaggccagtggatagtgaccaactctgtgttggtcgcctcatgtttcccagcacgcagcccttttgtcctcatcatgagtgatactcatatctctcagttctgttttgcctgcaggacaaggaaaacactctttcctaatctggttgtcatgccatga

SEQ ID NO: 571 - DNA, 2240 bp, Homo sapiens
  CDS (1)..(1779)
atgcagggtgagcggaagcaatttgctgtggtgcttcttagcctgagacttttggctaaattcctgggctttgtggctttcctgccataccgggggcctgaacctcccccgaccgggacctgccccctgactgagctctggccctcccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagatggtgatgagagtgcggtggtgaatggcttgatagcaaatgagtctctaggaggcagtcgccccagtatttggagacaatttcagaaatgttctatgtgggaggacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctccgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgcca

SEQ ID NO: 572 - DNA, 1577 bp, Homo sapiens
  CDS (277)..(1095)
tgctccagtgtgcctggtgccggggccgtggggaggaggcgatttcgctccctgcggctgggctcggaccgggcgcccgagcctcctcggccttggagagcagcggcggcgggggaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcggaaggcagcatccctgcatgccgtccatatacaacccctctttgaaaaaagacacagagaataaactcctacgaaagccctacattgagctccaatctgctcggggtgggacgggtgcttcccacacctttgggaccctcgaccccacccttctttcctaccagcccagagccttgtggcttgtacagttttgaaactcccgttctattttatgatggttgataatagtcagtaacctaataaaggaacgtttgttaaaatatcaaaaaaa

SEQ ID NO: 573 - DNA, 1689 bp, Homo sapiens
  CDS (116)..(1657)
ctaggcagcatcccagtggacttgagtctggaatgcagatgtaggagagtctggcattacaccaccaccccctagcctcaccatcctggtaacagtaccctctgcttctcctgggatgtcacagctgggaaaccccaccttgccagcctccagcatgcaggataccgtaacgacatcagcattgttggaccccagccactcctcagtctccacccaggacaattcctccactggaggacacacttcaagcacaagcctacagctctcaaagccttcaatcacaccagtccctgcaaagtccaggaacccacatcccaggcccaatatccgtcggatgcgccggatcattgctgaggatcctcactcctcactggccatcgtgcccctcctcacacagctctgcattcagcacattatcaggaacttccacaaaaaccctatcctcaagcagatgctcccggaacaccagcagaagctcctgaaccacctctcccctgacctaccactggctgtgaccgccaacctgatagacagtgagaactactggttccgctgctgcatgcatcgctggcccgtgtgccacgtggcccaccatggcggcagctggaaacgcatgttcttcgagcggcacctggagaacctgctaaagcactttatcccaggcaccacagaccctgcggtcatcctcgacctgctgccgctctgccggaattacgtgcgcagggtccacgtcgatcagttccttccgccggtgcagctcccggcccagctccggccgggcgaccactccgactcaggcaggcagccacagatcgagcagcccaccgttgaccactaccaactgggcgatctgctagctggcctgagccacctggaggagctgcacctggtctacgatgtcaagcactgcggcatgaatttcgagtggaatctcttcctcttcacctaccgcgactgcctctccttggcagccgccatcaagccatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggcgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccatcactgccaatggccctgagaactctgtgggataaaatgacctgacttggaaaaaaaaaaaaaa

SEQ ID NO: 574 - DNA, 1702 bp, Homo sapiens
  CDS (141)..(605)
gcccttcccgaccgtagcgagggtgctgctgcgctgggggaaggaaaacgccgctttgactgtgccttgttctcacagctggcgggaagcaagcgccttttcgaaagccagaggctcgagttacccctcttaccaccgtcatggcagtcccaggttgcaacaaggacagtgtcagagcaggctgtaaaaaatgtggctaccctggtcacctgacttttgaatgccgcaattttctccgagtagaccctaaaagggacatagttttggatgtcagcagtacaagtagtgaagatagcgatgaagagaatgaagaactgaataaattgcaggcattacaggaaaaaagaataaatgaagaagaggaaaagaaaaaagaaaaaagcaaagaaaaaatcaaattgaaaaaaaaaaggaaaaggtcttactcatccagttccactgaagaggacacttcaaaacaaaagaaacaaaaatatcagaagaaagaaaagaaaaaagaaaaaaagagtaaatcaaaaaaagggaaacatcacaaaaaggaaaaaaaaaaaaaaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttatgaagcttgtttctatgagtactgtggaaaattttataaatgtgagcatatatatttattttgtctgacataatttgtagttttaaagcaagtttcacactgaacttaacgttttcataaatgaccagtttgggatgtttctctcttttactttagtggcaaactcaagagtaaaaagtgtcaaaaaaaaaaaa

SEQ ID NO: 575 - DNA, 374 bp, Homo sapiens
  CDS (72)..(323)
aaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaagggttcgctacactaacagctccaccgagattcctgaattcccgattgcacctgaaattgcact

SEQ ID NO: 576 - DNA, 2466 bp, Homo sapiens
  CDS (8)..(1489)
gacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcaagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttaaaaaccacatcactgtgactcaaggaaagtcactgacagcataagagaagtttgctaaaatatttgtatgtggggttaggtgtgggggatcctctaa

SEQ ID NO: 577 - DNA, 2043 bp, Homo sapiens
  CDS (222)..(623)
ggttggggcggggcgcacgggggagggggccaggtcggagggaagcccgcccgtgcccgagcccgcgcccgagcagggactacatttcccgggggcctcggcggcggctgcggcgacgggcgcggcaacgtcccccggaagtggagcccgggacttccactcgtgcgtgaggcgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaaattgatacgatcatcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgttttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaactccggaattcagtaattgtcttctttattgacgaattcctcccctcaaaaaactgtctttcc

SEQ ID NO: 578 - DNA, 1325 bp, Homo sapiens
  CDS (554)..(874)
gaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttaga

SEQ ID NO: 579 - DNA, 1664 bp, Homo sapiens
  CDS (12)..(1661)
tttcgtaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtttccaactgctaaaaatctcagtaccacaatgcgctttgaaagtcatattacactacctatttttattttgaataacagactcctggtggactttccggaaatagaatctaaatttccataa

SEQ ID NO: 580 - DNA, 2948 bp, Homo sapiens
  CDS (125)..(1381)
gcttctggctgcgcggcctgcgcgcgcctcccgggcggattccagccccgagcgggacagcgcggcggggagcgacgagatttctctctgatcaaacggacagttcaggactcagaatctaaggatgaatgttcaccgtggcagtgacagtgacaggttattgcggcaggaggccagctgcttagtggatgatactttagctgtagcccaagaaaaagaagcaaacagcctggcttcatctggtcctcataatcttacttatcctctaggtcccaggaatgaagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggatgtttggaccaggaagagagtacaacttcactcggcccaatgagaagggagagtatgagattgctgaaggcatcagtgcaactgtatttcgcacagtgctggattattacaaaaccggtatcatcaattgtcctgatggcatctctatcccagatcttagagatacttgtgattatctctgcattaattttgacttcaacactatccgatgtcaagatctgagtgctttactccatgaactgtctaatgacggtgctcataagcagtttgatcactacctcgaagagctcatcttgcccatcatggtgggctgtgccaagaaaggagaacgagagtgccacattgttgtgctgacggatgaggattctgtggactgggatgaagaccaccctccaccaatgggggaggaatattcccaaattctttatagctccaagctctacagattcttcaaatatattgagaatagggatgttgcaaaaacagtgttaaaggaacggggcctaaaaaacattcgcattggaattgaaggttaccctacctgtaaagaaaaaaaaaaaaaaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaatgtccaaaaggaaattcttaagagcttaaattcagatttgtgtctcattaatgcagtgaacaattcaaaaccacacagattccttggcaggaaggataatggaataacagtgttgatgagacctttttagcttcaaggtttcggagtctaaacaaatggatgattcatttggaatgaaactcacaatgcaagtagaaggacctctccaaatcaggccagttgggttatcctggcttggaatctggtgtgaaaccataggtcttaacactctggagcagcacattgctgtggatatgtccaggagaccttagatatggcttaaaggctttcaagatgaggacagaaattgcttacaattgctcagtttctcaacagaaagactcataagagtgccagcatggggtacatggagtgaagctgggtgggaagcatcatctgcacagtccctgtcctagtgcaggacttttctctgtatgttttcataccatgggatttttggatatcagtgtattttggttcttgaaatagcctaatagctgctcacacattgggtaggaatattataccaatgtcatccccaaaggaagggtgagctgaatggaaattaagcccagtcattttatttgatctattagctctgttatcagtgcatgatcacccagatcaccctcctcagcccacacagtgctgaaccatcttccctcctgttctccatggctattaatagtatagctaaatttagagtgcagagccagatataagtattttggaattatctcccagtttgtgggtagaagctgactgggatacagggttgagtatctcttatccaaatgcttgggcccaaaggttcgaattttccgatttgggatcttacactgggccccatctgaagtctgaggcctgtccctccaactgtttgggcccttcgcttggttcgggccccgcgggaggccccaggggtctcccgaaacggtttccggcaaggttctctgcagcgtagggcccccggccggctg

SEQ ID NO: 581 - DNA, 6553 bp, Homo sapiens
  CDS (272)..(5242)
gtccggaattcccggtcgacagtctcccagaacaattcccaggagctcggattccaagagccgcccttgccctcgtttaccttcgctagtcgccctgcagccccgccctgtccggaggccccgccctccatgaatcagctgatcccgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccaatgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaaaaaaaaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatattgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctggttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatctttaaaaaaaaaaa

SEQ ID NO: 582 - DNA, 2087 bp, Homo sapiens
  CDS (70)..(489)
catgcgaagggtcagcttggcacgagggctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaaggtggggagccaacatacaatgtggctgtcggcagagctggtagagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaacgcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattccagtatttgcttctattgtttgggccttgtggataatggacagatttaaaaacaaatcttgttggtgatttgtccatttctttccctgccctttgttacatttgggaaacagtttaactcatttgatttaatatgcatttaaaaaaatgccataactattaaaccccttgtttacagacagatgaaataaatttattccaacccaaaaaaaaaa

SEQ ID NO: 583 - DNA, 2039 bp, Homo sapiens
  CDS (70)..(441)
catgcgaagggtcagcttggcacgagggctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacgccaatagaaatagatatgattgtaggaaaagaccgggaaggtttctttaccaacggtttgactcttggcgcgaagaaatgctcagtgatcagagatagtctatacgtcgatggtgactgcacaatggacatccggacaaagagtcaagtggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattagcaatgcagggtgatggggtatgaacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaacgcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattccagtatttgcttctattgtttgggccttgtggataatggacagatttaaaaacaaatcttgttggtgatttgtccatttctttccctgccctttgttacatttgggaaacagtttaactcatttgatttaatatgcatttaaaaaaatgccataactattaaaccccttgtttacagacagatgaaataaatttattccaacccaaaaaaaaaa

SEQ ID NO: 584 - DNA, 2107 bp, Homo sapiens
  CDS (124)..(1164)
gaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacactatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcaaagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagcctcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgtactttagtgccccttcacggtacctcgtgtggggtggggactgagaactctttgagatgaaaaaattt

SEQ ID NO: 585 - DNA, 3744 bp, Homo sapiens
  CDS (12)..(2573)
tgcggcataagatgaccctcatctcgcccatcatcctgaaaaagtacgggatccccttcagccggatcacgcaggaggccggggaattcatgatcacatttccctacggctaccacgccggcttcaatcacgggttcaactgcgcagaatctaccaacttcgccaccctgcggtggattgactacggcaaagtggccactcagtgcacgtgccggaaggacatggtcaagatctccatggacgtgttcgtgcgcatcctgcagcccgagcgctacgagctgtggaagcagggcaaggacctcacggtgctggaccacacgcggcccacggcgctcaccagccccgagctgagctcctggagtgcatcccgggcctcgctgaaggccaagctcctccgcaggtctcaccggaaacggagccagcccaagaagccgaagcccgaagaccccaagttccctggggagggtacggctggggcagcgctcctagaggaggctgggggcagcgtgaaggaggaggctgggccggaggttgaccccgaggaggaggaggaggagccgcagccactgccacacggccgggaggccgagggcgcagaagaggacgggaggggcaagctgcggccaaccaaggccaagagcgagcggaagaagaagagcttcggcctgctgcccccacagctgccgcccccgcctgctcacttcccctcagaggaggcgctgtggctgccatccccactggagcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcgggggggaggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacccgagagaaacgcaggtgttccagaggcttccttgcagacaaagcacccctgcacctcccatggctcaggatgagggaggcccccaggcccttctggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaa

SEQ ID NO: 586 - DNA, 3258 bp, Homo sapiens
  CDS (66)..(2675)
tttcaactgggccacagaacaaaccagcccgcaaaacctctgcagcagacaatggcgagccgaacatgctgaaggagcacccagagaagggcgtgtacgtgaaggggctgtccatgcacacggtgcacagcgtggcccagtgtgagcacatcatggagactggctggaagaaccgttcggtcggctacacgctgatgaacaaggattcctcacgctcgcactccatcttcaccatcagcatcgagatgtctgccgtggatgagcggggcaaggaccacctccgggcgggcaagctgaacctggtggacctggcgggcagcgagcggcagtccaagaccggggccacgggcgagcggctcaaggaggccaccaagatcaacctgtcgctctcggcactgggcaatgtcatctcggcgctggtggacgggcgctgtaagcacgtcccctaccgtgactcgaagctgacgcggctgctgcaggactcactgggcggcaacaccaagacgctcatggtggcctgcctgtcgcctgcggacaacaactacgatgagacactcagcacgctgcgctacgccaaccgggccaagaacatcaggaacaagccgcgcatcaatgaggaccccaaggatgcgctgcttcgcgagtaccaggaggagatcaagaagctcaaggccatcctgacacagcagatgagccccagcagcctgtcagccctgctgtccaggcaggtgcccccagaccctgtgcaggtggaggagaagctgttgccccaacctgtgatccagcatgacgtggaggccgagaagcagctgatccgggaggagtatgaagagcgcctggcccggctgaaagccgactataaggccgagcaggagtctcgggccaggctggaggaagacatcactgccatgcgcaactcatatgacgtcaggctgtccacgctggaggagaacctgcggaaggagacagaggctgtcctgcaggtgggagtcctctacaaggctgaggtcatgtccagggctgagtttgccagcagcgctgagtacccgcctgcttttcagtatgagacagtggtgaaacccaaggtcttctccacgactgacactctgcccagtgacgatgtctccaagactcaggtttcctccaggtttgcggagctgcccaaggtggaaccctccaaatctgagatttctctgggctccagtgagtcatcctcgctcgaagaaacctctgtgtccgaggctttccctgggcctgaggagccctccaacgtggaggtctccatgcccactgaggagtccaggagcagatacttcctggatgagtgcctcgggcaggaggccgctgggcacctgctgggggaacagaactacctcccgcaagaggagccgcaggaggtgcccctgcaggggttactaggcctgcaggacccgtttgccgaggtggaagccaagctggccagactctcctccaccgtggccaggacagatgcaccccaggcagacgtccccaaggtccctgtgcaggtccctgcgccgacagacctgctggagcccagtgatgccaggcccgaagccgaggcggctgatgacttcccgcccaggcctgaggtagatctggcctcggaagtggccttagaggtggtgcggacagcagagcctggcgtgtggttggaggctcaggccccggtggccctggtggctcagcctgagcccctgccggccacagctggtgtgaagagggagagcgtgggcatggaggtggcagtgctgactgatgacccgctgcccgttgtggaccagcagcaggtgctggcccgtctgcagctgttggagcagcaggttgtgggtggagagcaggccaagaacaaggacctgaaggagaagcacaagcggcgcaagcgctacgcagacgagcgcaggaagcagctggtggctgccctgcagaactcggatgaggacagcggggactgggtgctgcttaacgtctacgactccatccaggaggaagtgcgggccaagagcaagctgctggagaagatgcagaggaagcttcgggcagcagaggtggagatcaaagatctgcagtccgagtttcagctggagaagatcgattacttggccaccatccgccggcaggagcgtgactccatgctcttgcagcagctcctggagcaggtgcagcccctgattcgcagggactgtaactacagcaacctggagaagattctgcgtgagtcctgctgggacgaagataacggcttctggaagatcccacatcccgtcatcacaaaaaccagcctcccagtagcagtttcaactgggccacagaacaaaccagcccgcaaaacctctgcagcagacaatggcgagccgaacatggaggacgaccgctacaggctcatgctcagtcggagcaacagtgaaaacattgccagcaactacttccgatctaagtgggccagccagatcctcagcacagacgccaggaagagcctcacacatcacaactcgccaccaggcctcagctgcccactcagcaacaactctgccatcccacccacccaggcccctgaaatgccccagccccggcccttccgcctcgagtccctcgacatccctttcaccaaggccaagcgtaagaaaagcaaaagcaactttggcagtgagcctctgtgagcacagctgcttgccattgcctgccttataggcatgtagagactgccaggccctcccagggcagccccaaccaggtctcctcccacctgccacacagcgctccggggcctgagggctccctcagccctgggaagacacattcccttccctgttccccagagagcccacctctgccctgggcaggagcccctcggaggctgtatagtcctccttagagaggcctgctccagctgttcataccacatcagtgtttccgtctgctcacctgccacagagcccacacccatgcccaccagtgttggtctttgcctcaaagcctgagacctgcttcacggccttcaccagccctgatggagagggcagcagctgccacgtggaggaagctcaatatcagctgggaaggaactgtgcctctgtctgactggccccacttcctaagcactgccctgccccatggggtggcacaggggtcccacagcaggtcttcctgcactgcccacccctggctggtctgtggcccaaggaaggccactccacattaagctgcccaataaactgcttttaagataaaaaaaaaaaa

SEQ ID NO: 587 - DNA, 1244 bp, Homo sapiens
  CDS (259)..(1170)
ccccccagcagggggtggtagcgtgacaactacgtaccttccgcctattttggtgacactatagaacaagtttgtacaaaaaagcaggctggtaccggtccggaatttccgggatatcgtcgacccacgcgtccgatggccctgagtgggactcggcccagaagccgagggactctctaggctgccgggcgctggtcgtcagcgccgaggctgggctgaggcgccgcggtaccatgaggcgccggtacttaagagattatggcatcagaaacccacaatgttaaaaaacggaacttttgtaataagattgaggatcatttcattgatcttcctagaaaaaagatctctaatttcactaataagaacatgaaggaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattgagagatttcatctactaaagagcatttggtttttcaaaacatccctgaactgtataatttacaaaaaaaaaa

SEQ ID NO: 588 - DNA, 1845 bp, Homo sapiens
  CDS (91)..(1395)
ggagcagcaggagcccctgtgttggcagggttaattgaccatgatcagcaggtagctacaattagacaaggggcacgaaggacaccaaaaatgtgtcctctgggttccacacatatccttcctgcccctactgtggaacagcagccttacctacctgctgatcatggtcaattaaccctgccaacacaggggctcctgctgctccctagacataaggagtcaaaggtgctcagatccgaagccaacgacttagccttacgcctggctcggcagttcagaggccaccaggatgtgatcactcttgaccatgcttaccatggtcacctatcatccttaattgagattagcccatataagtttcagaaaggaaaagatgtcaaaaaagaatttgtacatgtggcaccaactccagatacttacagaggaaaatatagagaagaccatgcagactcagccagtgcttatgcagatgaagtgaagaaaatcattgaagatgctcataacagtggaaggaagattgctgcctttattgctgaatccatgcagagttgtggcggacaaataattcctccagcaggctacttccagaaagtggcagaatatgtacacggtgcagggggtgtgtttatagctgatgaagttcaagtgggctttggcagagttgggaaacatttctggagcttccagatgtatggtgaagactttgttccagacatcgtcacaatgggaaaaccgatgggcaacggccacccggtggcatgtgtggtaacaaccaaagaaattgcagaagccttcagcagctctgggatggaatattttaatacgtatggaggaaatccagtatcttgtgctgttggtttggctgtcctggatataattgaaaatgaagaccttcaaggaaatgccaagagagtagggaattatctcactgagttactgaaaaaacagaaggctaaacacactttgataggagatattaggggcattggcctttttattggaattgatttagtgaaggaccatctgaaaaggacccctgccacagctgaagctcagcacatcatctacaagatgaaagaaaaacgagtgcttctcagtgccgatggacctcatagaaatgtacttaaaataaaaccacctatgtgcttcactgaagaagatgcaaagttcatggtggaccaacttgataggattctaacagttttagaagaagctatgggaaccaaaaccgaaagtgtgacctctgagaatactccatgcaaaacaaagatgctgaaagaagcccacatagaactgcttagggacagcaccactgactccaaagaaaatcccagcagaaagagaaatggaatgtgcacggatacacattcactgctcagtaagaggctcaagacatgactgatttgcattttaaagcaagatgcgatgtccagagttacagagaatgagtagatgtgtctcatcggttaatagctctattatacctctaaaggtggaattgtcagtttagattcataaatgaaaaggtaaatgagtaatcagaataaaccaagtgataatcaaaccatgtcaagattattagttcagactctagcctgttaattttcttagttgatttctgaagctacctgatttattctattaaattgtaagcttgcaaactcaaaataaattggcagatttacctctcatgttttaatgtgtcaaattagagagcaaagtataacaggtgccttcacttttgagacttagtgccttaaaatatgtattctataatgatttcatatataaaagtatatttattgactgtaataaaataaaatatgatgtaaacaaaaaaaaaaa

SEQ ID NO: 589 - DNA, 3678 bp, Homo sapiens
  CDS (312)..(1478)
cccctcacggattacctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgtttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaaaaaaaaaaaaa

SEQ ID NO: 590 - DNA, 1694 bp, Homo sapiens
  CDS (349)..(1467)
cgctccggcagcgcgctctgcccggcttcctcagtctcctcgccgggagcgtccgggagcagctccgaggccgcggcgaaaccagggagcagggattggatcaagtcattgcatctagagtacgggggaacgaagaaatcatggagagagtttgccccaggagagaggcgagcgttatgtaacctaggatctggggtgggtaacagtctgtgcagtgtcaatctgagaggagaaaacacccaacgtgagggaatggtcagccttgtcatttcagcattctggccttccctatgaggaggaagatcaacgaagtcacagggcccttctagcccaatccagagctgtaccatggcagagacaagagaagaggagacagtgtcagcagaagcctcagggttctcagacttgagtgactcagagttcctggagtttctggacctagaagatgcccaagagtcaaaggctttagttaacatgcctggcccatcttctgaatcccttgggaaggatgacaaacccataagcttacaaaactggaaaagaggattggatatattatcacccatggagagattccaccttaaatatttatatgtcactgacctggctactcagaactggtgtgaactgcaaacagcatatgggaaggagcttcctggtttcttggcacctgagaaggcagctgtgttggacactggtgccagcatacacctagctagagaactagaacttcatgatcttgtgactgtcccagtcaccactaaagaagatgcttgggcaattaagtttctgaacatacttttgctgattcctaccctgcagtcagaagggcacatcagagagtttccagtgtttggggaagtggagggtgtacttcttgttggagtgattgatgagctgcactatacagccaagggggaactggagctggcggaactcaagacacgcaggcgccctatgctccctctggaagctcagaagaagaaagactgttttcaagtcagcctatacaaatatatctttgatgccatggtacaaggaaaagtgacccctgctagcctaatccaccacacaaagttgtgtctagaaaagccactggggccatcagtgctgaggcatgcccagcagggaggcttctctgtgaagtctttgggtgacctcatggaacttgtcttcttgtctctaacactgtcagacctcccagttattgatatcttgaagattgagtatatccaccaagagactgccactgtgctgggtactgagattgtagccttcaaagagaaggaggtgagagccaaggtgcagcattatatggcctactggatgggccaccgagagccccagggagttgacgtggaggaggcttggaagtgccggacgtgtacctatgcagacatttgtgagtggagaaagggcagtggagtgctcagctctacactggcgccccaagtcaaaaaagccaaatgaatagaaggtatgctttcaagaatgttgatccttcctgctcctgttgtacctaagcaaaagaggaccagtctctgagcttggcttttatggagagtgttcttattttggctcttttttttatttccacaacctctaaccacattcagtccaggaccaaggctcagggatgagtgggagagatgggttatactgtccctggagcttcatcatgattgcctgagaag

SEQ ID NO: 591 - DNA, 7847 bp, Homo sapiens
  CDS (382)..(3159)
  misc_feature (1)...(7847): n = a,t,c or g
atgcagggtgactgtctgaggcctgagagtggggcccatgtgcaagcccaagaaagtggctggtgtgagaatgagggtgttcagactattgaagggtgtttggatgaaagaggcaggcgcggcgcggcgcggagcgagcgggcgcagcgcggagctcgggcccatggtgcgcccgtgtccgtcggtcgggccgcgcgggcgctccgcgcgtggcccggcgctcgcgagctcgccccctcgctgcgggcccggcccgcccgctgccgccgcctcctcccccggggcggcgcggcgccggcgggcggcggcgcggaggccggaccgggcggcggcccaggcggcgcggggggcgcggcggccaaggcgggcggcgccgccgacatgacggacaacatcccgctgcagccggtgcgccagaagaagcggatggacagcaggccccgcgccgggtgctgcgagtggctgagatgctgcggtggaggggaggccaggccccgcactgtctggctggggcaccccgagaagagagaccagaggtatcctcggaatgtcatcaacaatcagaagtacaatttcttcacctttcttcctggggtgctgttcaaccagttcaaatactttttcaacctctatttcttacttcttgcctgctctcagtttgttcccgaaatgagacttggtgcactctatacctactgggttcccctgggcttcgtgctggccgtcactgtcatccgtgaggcggtggaggagatccgatgctacgtgcgggacaaggaagtcaactcccaggtctacagccggctcacagcacgaggtactgttgtgggtgttgttctttacactggcagagaactccggagtgtcatgaatacctcaaatccccgaagtaagatcggcctgttcgacttggaagtgaactgcctcaccaagatcctctttggtgccctggtggtggtctcgctggtcatggttgcccttcagcactttgcaggccgttggtacctgcagatcatccgcttcctcctcttgttttccaacatcatccccattagtttgcgcgtgaacctggacatgggcaagatcgtgtacagctgggtgattcgaagggactcaaaaatccccgggaccgtggttcgctccagcacgattcctgagcagctgggcaggatttcgtacttactcacagacaagacaggcactcttacccagaacgagatgattttcaaacggctccatctcggaacagtagcctacggcctcgactcaatggacgaagtacaaagccacattttcagcatttacacccagcaatcccaggacccaccggctcagaagggcccaacgctcaccactaaggtccggcggaccatgagcagccgcgtgcacgaagccgtgaaggccatcgcgctctgccacaacgtgactcccgtgtatgagtccaacggtgtgactgatcaggctgaggccgagaagcagtacgaagactcctgccgcgtataccaggcatccagccccgatgaggtggccctggtacagtggacggaaagtgtgggcttaaccctggtgggccgagaccagtcttccatgcagctgaggacccctggcgaccagatcctgaacttcaccatcctacagatcttccctttcacctatgaaagcaaacgtatgggcatcatcgtgcgggatgaatcaactggagaaattacgttttacatgaagggagcagatgtggtcatggctggcattgtgcagtacaatgactggttggaggaagagtgtggcaacatggcccgagaagggctgcgggtgctcgtggtggcaaagaagtctcttgcagaggagcagtatcaggactttgaagcccgctacgtccaggccaagctgagtgtgcacgaccgctccctcaaagtggccacggtgatcgagagcctggagatggagatggaactgctgtgcctgacgggcgtggaggaccagctgcaggcagatgtgcggcccacgctggagaccctgaggaatgctggcatcaaggtttggatgctgacaggggacaagctggagacagctacgtgcacagcgaagaatgcacatctggtgaccagaaaccaagacatccacgtttttcggctggtgaccaaccgcggggaggctcacctcgagctgaacgccttccgcaggaagcatgattgtgccctggtcatctcgggagactccctggaggtttgcctcaagtactatgagtacgagttcatggagctggcctgccagtgcccggccgtagtctgctgccgatgtgcccccacccagaaggcccagatcgtgcgcctgcttcaggagcgcacgggcaagctcacctgtgcagtaggggacggaggcaatgacgtcagcatgattcaggaatctgactgcggcgtgggagtggaaggaaaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggctgtcttttcctccgtgttttactttgcctccgtccctctctatcaaggattcctcatcattgggtactccacaatttacaccatgtttcctgtgttttctctggtcctggacaaagatgtcaaatcggaagttgccatgctgtatcctgagctctacaaggatcttctcaagggacggccgttgtcctacaagacattcttaatatgggttttgattagcatctatcaagggagcaccatcatgtacggggcgctgctgctgtttgagtcggagttcgtgcacatcgtggccatctccttcacctcgctgatcctcaccgagctgctcatggtggcgctgaccatccagacctggcactggctcatgacagtggcggagctgctcagcctggcctgctacatcgcctccctggtgttcttacacgagttcatcgatgtgtacttcatcgccaccttgtcattcttgtggaaagtctccgtcatcactctggtcagctgcctccccctctatgtcctcaagtacctgcgaagacggttctctccccccagctactcaaagctcacatcataggccgtgcgttcgctggagggggccctggtcttggcgcttccctgatggacagagctcaagttccatttatattaaccgccacctgtggattttgcagtaattgctaacacatgcagttttaatgggaagcggctctgcgcctaaacggagtcctaacgctgcatcaacgggagggagggtcctgaaagagacccatctgggcctgtctgaacccctcgttcttcatgtttaggtgaatatgaatatgttaaagctggtggctcagctgggagatttatatgggtcactgtgcgagcttccttatgacttgaattttgttgtcacatgataaaagtttctgtgtagctgaaggttgtagaaggcttgtttgtgtgtntgtgtgtgtgtgtgtgtntgtgtgtgtttttaaagagtcctaatgtgtatgtactctttatgtctttcttgctcttacaaagaggtgtcagaaaaatagaaagctcttggtgtcggtttgggaggaaaagacagtgacatttggtaaaaagttatccacacaataatctccattcggaaatgctcagtatcgtctccagccagccctgcttatccaggttacactggattcctgggatcgtaaccagtaaatgagaggagagggagagagagtgtcctaagtccaatctgttatccttgatctgattcagcatccatagtgtgtgagttaacttcacctgccacctcgtaaaagaatttcagaggtgtgatcccgctttattgggacctggtaacaatcacaaagccagtggctgtttgagaaggacctcagacattttcagcagagttgttttagcaggaaacgtgccactgaatggcccctaaatgtgtcgacagtgtgataagagactcaactaattctttaggcaacatggcagatgtgactcagatcctccaagaccaaagcggaaaggtcagggggctgggactcttctcttccatagaagcctgtttcctgttaggaggcataatggaagatgaccccacaaaggcagaggcatctttcggaacaacactggtggcagctttcagaacaaggaacccctggtgggaggacgcccaagctacagcgttgggatctgggatctgttccactgccggcagatttcaaggggaacttgctgaaaggcagccagtggtgaagatttctcccctcccaggatggactacatgccggcatgtttcttataaagctgtggctgcttgtttcagaggaagggagtttgcagtcgcgggacgtggtagagcaaggcattcttgggttttcaagttgcttcttgcagaagccacatatgcatgccataagggttaagttggtggatctttaagagccaagtgtggttgagatcttggatttgcgtttacttcttgatgaatacatatccttcaaaccctctgcctggcgctacttctgtgtgcttcagagaggtacatcacagcctggtttctgatgcctactaactcctgctcttggagagctggagacacgaggatcagatagtcccttgcctttggagcactcttgataagcttttgtattttgtgttgtccttttaaaatgttctagaatgactttacgttgcaggtactggttaattggctgttgacaccacatctattttgtcttatgattctgcagttttgcagtacttttctctatctgattcagccatttctgccagagggaaaaggtcggcagaaaagatgtattgagtgaatagttaaggataggatctttgtccaaaaatttcagaaagattgagcaaatctgacgtattcattgagtgagtttctgtgttttcaaaggtggaggagaaatttgtgctggaagtttttaagcctccgttttcttggaaatcagtctgtaacactggcaagtcttaagatagtcccgtttagactttgcagatgctgaacctggctctgtaacgctgggaagtcttaagatagtcctgtttagactttgcaaaccctgtacctggctttgctcggagattcgggatgctggctcctgcaggcagggcgtgtgggagcctcgtcagaaagttttagaggtttccagcagaagcagaatgaagatggtctccctggccttttccttaattctcaattttgattgaggtgcacaagttgacttttaaagccaacgcttaagatactgattgacatcttcaagggagaatgctcccaggaggggctgaagaagccatagttggaagtggaaggtactcgtcagtgttctccacaaacctttttactctgttgtctcagccgcactggggcggaggcggtcaagggtgagaagtaccgacactcaagtgcaaactgccacgtcgttggcccatcccatcagtgggcagctggctgacgccattcactggacggtccctgaacacctaggaatgcacacaccgtgcttctcagacactggagacgcaaaggcaggaggatgcagtccggtgagaggacacgatctttacctgcacaatcagactgtaagcccagcagagaaccccaggggcgcctgggtacttctcggaggtcatcttagttgtggtggggaagacaaagaaataagcaaacaagaaactagagttactatacaagaaactctcctgagtttgtaaaccttaagcataaggattcagttgacctttttcttggttcatcaatctggaaagaacttacataaagcgccattgacactgtcacctgggagctccatgggccgtaagtctttgacagccaatttaatttgaggtcagagggccttgaggtacacagtcagcactgtttgaacacttttcctgaaagcaaaactcacagctccctgcgccctctgacaacactagctatttctgccagagtaagaacttctattactattttattattgttcatatgtcttttgatgatggttgtgtgacagggggaagcaggatctatttggtttcttccccctccccccaccccttcctttttgtctctctttttttttctctaagaaaatcaccagactagtttttccatcttgagtaatttcttatgtgggacagttttgatcctcattttgaaagcatgcgtgcgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttgtgacagtaaatcttaaaaatcattgtctctttatgaacatttcctcagtttcttctctgctgaaaatgtaagccatgctactttttaatgtattttgaattttgtgctcattggaaattgatatgctaatgcctcccccaccccccgccagacttttctttttatactttgtcttgtttttactggggtaggctgggcatgcgtgcgtgcctttagggcagcattttaaacctttgccaaaattgcaaatgggacatgtacattcttctgctccatcctacttaaacacctatcagctatttttatctttaaccttttctgtatgtttgaagtgtgtggggggtgtgtgtgtgtgtgaaagagcgagagaatgatgtcatctaaagttttttgaagaattatttggttttcattgcattaaaattctatcactcccagctttgttttcatttaaaaaaatatacaaagagctttgtaaatacaacacattttatttctcccccttcttttaatgtacagcttttttgccacttatatatacttaaaatattcccatgaattatgtccagttcttcttggaaaaaaatttggttttgaatgaacctgcaaagcatcctgcagcgtgagcagctcctccacctggagctccgaagcatcttctcaggccaaagcggcattacccgtgaatctgtcttctccgccacagcatggtttgaggcgcagtctgttaatatagctgggccatgtcagtgactgttgtgtttgtggggtcaggtggggggcatggtatttgcaaaaaaaacaaattatggctaatttattattttgttgcagtggggttaactgtaaactcatgtaagagtctgtgatttcctcattggttgatctctctctctgtaatcctcattgcaaattttcaccaggacagcgttttttgattagaggggagctctggcacagtatgctttaatttagcaggaacttccagatgatttaaattctcgatgctgtgatgacacacatatgatctttcgtgtttctgagcgactctactttcattgtttgccagcgtggctcgttgctgttgcccaataaagcttgtgtacgttctgccttgggggattattttaatttgtacagaaacatgaattctggtatcaaaatgaggactttttattataacgctcctattttttctttatttcatggtacatgaaatgtaaagaaaactctttccagttcagaaaattattttgattttggcaaaaaaaaccccaaatcaatgcatgttatttattattttgtactattgtccatcccagacgtgtcagaatttcaaaaggtgatagatataaatggaa

SEQ ID NO: 592 - DNA, 2096 bp, Homo sapiens
  CDS (110)..(1630)
aagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgattatcagcaaaaaaagatggtcatggggaggctctgcaatggcgaattctgagagcaaaactgccaataaacgatctgcatctactgaaaaacttgaacagggtacttctgctttaatcagacaaatgcctttgtcatctgcaggccttcaaaattccgttgccaaaaggaaaacagacaaggagagaagctcatctttaaatagaagagatagtaacctacattcgtctactgataaagaacaagccgaaaggaagccacgtgttacaggcgtcaccaattatgtaatgcagtatgtcactgtacccttgcgtaaatgtactagcgacgaattgagggctgttatgtttcccatgtcgacaatgaaaatacctcctcaaacaaaagtagaagagtctcccttggagaaagtagagacacctcccaaggcaagtgtggatgcacccccccaggtgaatgtggaagtattctgcaacacaagcatggaagcgtcccccaaggcaggtgtgggcatggcccctgaggtgagcacggactcattccctgtggtgagcgtggacgtgtcgcctgtggtgagcacatatgattctgagatgagcatggacgcatcccccgagttgagcatagaagcactcccgaaggtggacctggaaacagttcccaaggtgagcatagtagcatccccggaggcgagcctggaagcacccccggaagtgagtctggaagcactgccagaggtgagcgtggaagcagccccagaggggagcctggaagcacctcccaaggggagcgcagaagtagcccccaaggagagtgtgaaagggtcacccaaggagagcatggaggcatctcctgaggcgatggtgaaagcatcccccaagacatcccttgaagcaagcatggaagcatctcccaaggcaaaagcgagagacgctccaaagaaatcagaaatggacaaacaggccttaatccctattgccaagaagcgtctatcatcatacactgagtgttataaatggtcatcatctcctgaaaatgcttgtggtctgccgtctcccatcagcactaacaggcaaatccaaaagaactgccctccatcaccattaccacttatttcaaaacagtcaccacagacttcttttccttataaaataatgcctattcaacacaccctgtctgtgcaaagtgcatcaagtactgtcaaaaagaaaaaagaaacagtttctaaaaccactaacagatgtgaggctttgagccaaaggcatatgatctatgaagagtctggtaataagagtactgcaggtattatgaatgccgaggcggcaacaaaaattttgacagaattgcgccgccttgctgatgatggcggacggcgccgcagctggcgctggcggcagcccatccttgagagagctgcgggcacggatggttgctgcagcaaacgagattgctaaggaaaggaggaagcaagatgtggttaatcgtgttgcaacccattcctcaaatataagatcgacatttaaaccagtaatcgatggatccatgcttaaaaatgacataaaacaaagattagcaagagagcgcagagaggagaaaaggagacagcaagacgccaataaagaaacacaactacttgaaaaagaaaaaaagaccaagctccaatatgaaaaacagatggaggaaagacagagaaagctgaaggagcgaaaagagaaagaagaacaacggagaatagctgcagaagaaaaaagacaccagaaggatgaagcacaaaaggaaaaatttacagccattctttatcgtactttggaacggaggagacttgctgatgatatcaaccaaaaagatggtcctggggaggcttctgcatggcgaattttgagagcaaaactgccaattaacaactgctctaccgaa

SEQ ID NO: 593 - DNA, 1248 bp, Homo sapiens
  CDS (105)..(866)
tcgaaggactgtatcttttgtacactggttaaccaattgatgcccttcgacattttaataaagctcggaaagatcgtgactggggccacaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggtttgagctcagtgctttgttattagaagtatacccttttttctccagcagaggttgctgctgtacatcaagagaagtactatgtgaaattggtgtttcctaatggagttgaatgagagctggtctatttgactctgttttgattgggtacagatttggtgactctgtggtaaagactataattatttctataaagaatattttgttaaaatctaggtaattaaataccctgtatcttttctaaggaatattatttcaggaaatatatttaaaatgcattgttctcttttaaaaaaaaaaaaa

SEQ ID NO: 594 - DNA, 1625 bp, Homo sapiens
  CDS (390)..(1421)
aaggatccttaattaaattaatcccccccccccggccagatgggggcgtctcccggccttgttgactttggcgtccgcggggagctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttcataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggatatcaaagaagaggaggaaaaagatcacaatgaagcaatggaagcagaaggagccacctcaaaatttactgggagaaacaatcatgaaggctgccctccctgaatctttaacagcctacttgacatatttacaagacagtaacttagataaggagaaaatggctatggaatatcctaatcctgaaatgtgcattggtgcggttcagcaaaatatcttcctcaagcatttctgggaacactgcttgcgcgcacacccaggtttctcgggaccctgcttgctaccagagagagttcccgactgccg

SEQ ID NO: 595 - DNA, 1444 bp, Homo sapiens
  CDS (200)..(1297)
tttcgtgccgctgaggtcggaacgtctgcgtgtgtgcgggctggttttgtggcggctgctgctagagctggagcatttgccgggttggtggctcctgcacatttttacagttctccagtccttctctttcgtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgaggtcattttgtgatccagtattttaattcagaaaaatttgagaatacataaatgaaacatgtaattattacatggttttgattgttttcccagttggtgcttttacagactaaagtaattttacagaataaaataacttaaatcaaaaaaaaaaaaa

SEQ ID NO: 596 - DNA, 1895 bp, Homo sapiens
  CDS (128)..(1633)
tattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaagcgtatgtattacccgcagcctgttggttccacttataagg

SEQ ID NO: 597 - DNA, 1934 bp, Homo sapiens
  CDS (172)..(1155)
gcagcccccggtcgcgacggctctcctcggggctcgggggcgctgggcggcggccctgggctgctttggctaacttggctgcggggcaggcgcgaggagcggcgcgccgaccgggccgagcggagaggccgcccattggccggccagcgccacaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgaaaaaaaaaaaa

SEQ ID NO: 598 - DNA, 2748 bp, Homo sapiens
  CDS (787)..(2142)
gggctccagctggggccggagaggctgagtggttggtacgctgctcgctggcctcccagtcttcccagcaaccggtgacactgcccgcgccagactgaccactagccgacgcgggcgagagggacaggagcgtgacctccccatcccgaggggccggacgctcgggcgcctccccgctccccccactcggaggccgcgcgcgccgttagccccttcctcgctcccccgccccagtcccgcagtccgggaggcgggggtcggcagccggctgagtgggaaccgcgcggtgtctgaggaggcagtcggcgaccggtttccacttcaagcgtgacccttttgcctgtgggatgagctccagcatggggtgaggtacagaagagagacttgaagagcgtgccttgggactcaagcgccaaacctgtaccctagcgagtgtcctactccgcatccgtaatggaaggaaatgcacatcttactccagaggcacaagaggaggacatcccatgcggctactcctgcccagcgtggtggggcagcagaagctccagagcccagacttgcaggctcacggtgcagggtgaacctggccacagctcaccctggaacagccacaatgtctgccccttagagaagaaccctgaaatcagaccagtttttgcggcctccccctttcctctctgttacagtgccctttccaggccttaagagaagtaaaacttagctgcagcgtcaggaggtggaccccagagtgtgagtggcacgcttctctgtgaacccgtcctcaccatgtttgccacatctggggcagtggcagcggggaagccttactcgtgcagcgaatgtggcaagagcttctgctacagctcagtgctgctgcgacatgaacgagctcacggcggtgacggccgcttccgttgcctagaatgcggtgagcgctgtgcacgggctgctgacctccgagcgcacaggcgcacgcatgctggccagaccctctacatctgcagtgagtgcggacaaagcttccgccacagcggccgtcttgacctacacttgggcgcacaccggcagcgatgccgcacttgcccctgccgcacatgcggccggcgcttcccgcacctcccggcgctgctgctacaccggcgccgccagcatctgccagagcggccccgccgctgcccgctgtgcgcccgcaccttccggcagagcgcgctgctcttccaccaggcgcgggcgcaccccttggggacaacctctgaccctgctgccccaccccaccgctgcgcgcagtgcccgcgagccttccgaagcggcgccgggctgcggagtcacgcgcgcatccacgtgtcccggagccccacgcgaccccgtgtctcagacgcccaccagtgtggcgtgtgcggcaagtgctttggcaagagctctacgctgacgcgacacctgcagacgcactcgggggagaaacccttcaagtgcccggagtgcggcaagggcttcctggagagcgccacgctggtgcgccaccagcgcacacacacgggcgagaagccgtacgcatgtggcgactgtggacgctgcttcagcgagagttccacgctgctgcgccatcggcgcagccatcagggcgagcggccacatgcgtgcgccacttgcggcaagggtttcgggcagcgctccgacctggtggtgcaccagcgcatccacacgggcgagaagcccttcgcgtgccccgagtgcggccgccgcttcagcgaccgctcggacctcaccaagcaccggcgcacgcacacgggcgagaagccctaccgctgcgaactgtgcggcaagcggttcacgtgcgtgtccaatctcaacgtgcatcggcgcaaccatgccggccacaagccacacaaatgccccgagtgcagcaaggccttcagcgtcgcctccaagcttgcactgcaccgcaagacgcacctgggcgaacggccagcggagtgcgcagagtgcggcaagtgcttcagccacagccgctcgctgtcacagcatcagcgggcccacacgcgcgcccgcaccgctgccgccgttgccatccagtccgcagtgggcactgccctcgtctttgaggggccggctgaacaggaaaagccagggttctctgtgtcctagttgagggaggcttgctgaggcttctctaaaggtggttgggcaagcacctatatagtatcacggggacagttgaggcaactcgtagatggagatttgggaaaagacgatgtggcctcctacctttccagtttctgttggcagcccttcacgtagcctcctgcctcgcctctacacctactaccctgtcggcccttttgccatgctgtcctcgtataactcggattctctcctcaggtgtaggtgcagggagtcagggaacccttagactcccctgtgtgcaagagcccaggtgttggtgtgtccctttaatgctactgtgctctctggtgtttctgattttcctgcctttattctgtcttctcttgtcctatctcattccagcccacatcttctcctttcctgattacttttgttgtcctgcctcttcaggtaatggtcacagatttggctgtaggcacgttaccagccctgtggcttcttgactcttggttccctgttaactctgtttctgagaaatgtgggtatggaggtgggtgggaaagctcacttccatgaaggatgtctccatgctaggagctgcctgcagctggcagaggtggccac

SEQ ID NO: 599 - DNA, 1866 bp, Homo sapiens
  CDS (166)..(1455)
ccaacccgtccggacagtccctcaccccggcctgcgctgctgcgtggactcgggcctcaggaattccgctgcggcccaaggcttgccgtttgacgaggagcagtcgcggtaggcggtgggcaaggctgccctgggcggaggccgaggcgcggctcggactccagcatggcgaccgcggtgcgcgctgtgggctgcctccccgtgctgtgtagcgggacggcaggtcatttattggggaggcagtgttccctaaacaccttaccagcagcttccattttggcatggaagagtgttctcggcaatggccatttgtcatcactgggaaccagagacacccatccctacgccagcttgagccgtgcactgcagacacaatgctgtatttcttctcccagtcacctgatgagccagcagtatagaccatatagtttcttcactaaattgactgcagatgagctgtggaaaggcgctttagcagagactggtgctggagcaaaaaaaggaagaggcaaaagaactaaaaagaagaaaagaaaggatctgaacaggggtcagatcattggtgaagggcgttatggttttctatggcccggactgaatgtccctcttatgaaaaatggagcagtgcagaccattgcccaaagaagcaaggaagagcaggagaaggtggaggcagacatgatccagcagagagaagagtgggaccgaaagaagaagatgaaggttaaacgggagcgaggatggagtggaaactcatggggaggcatcagtcttggcccccctgaccctggtccctgtggagaaacatatgaggattttgataccaggatacttgagggaagaaacgttttcactatgactgcgaaagagggaagaaagaaatcgatccgtgtcttggtggctgtggggaacggaaaaggagctgcaggtttttctattgggaaagctactgatcggatggatgctttcaggaaagcaaagaacagagcagttcaccatttgcattatatagaacgatatgaagaccatacaatattccatgatatttcattaagatttaaaaggacgcatatcaagatgaagaaacaacccaaaggttacggcctccgctgccacagggccatcatcaccatctgccggctcattggcatcaaagacatgtatgccaaggtctctgggtccattaatatgctcagcctcacccagggcctcttccgtgggctctccagacaggaaacccatcaacagctggctgataagaagggcctccatgttgtggaaatccgggaggaatgtggccctctgcccattgtggttgcgtccccccgggggcccttgaggaaggatccagagccagaagatgaggttccagacgtcaaactggactgggaagatgtgaagactgcacagggaatgaagcgctctgtgtggtctaatttgaagagagccgccacgtaacctctctggccttgtgcagccagttcctgtgctgccctgcacctaggaaagactcagcccctcacagcttgggatgttaccttgccttttgtttgttttgagggaagtttaatctttaaactctttggaaataaataattatagctttcatttgttgagcacatgttatatgccaatgtgatagaacctttacatacatatctcagttcaagactactttaaatattcatccaaagtaacaaaagtaaatgaattagggagacggggttaataatttgacccaatcagtaataatgtacacaatgataattgctgtagtaattatagctaatatatatgaactcattcatccaaagtgaatgtgattaacttcattttacagagcagttaagtaacttgactaccgtg

SEQ ID NO: 600 - DNA, 3414 bp, Homo sapiens
  CDS (316)..(3318)
gacaaaattcaggcatccaagactcatggtctgtttccagcttcccccggcagtgcatgggctcaagttcgtcccaagacatctgtctgtggacaggggaggaatcgaacacagggttctgtgtctgccctgctctgcccccagaagctagcaacagaccaccagccatccatcctcggtgagccagtaggtggtttgccacaggatcgagacggtgacctggccaggagcttctcccagggctttgtgacctacagtcaggagaacaattccgaaagctctctgcaaagttctagttccctcagcctttccactatgtctgtggccagcctgcctgccgtcaacaagatagatgagtcacgggaaagcagtttagaaggggaccttgcggtgaagtctgtttttcctccggagtccatggggacactccagaggtttaaggatacgcaagagactgaaaccggctataggtacatgaccctacacttcccctaccggcccactccagcctcggagaaagtgcccagtttccaacacagctcagtgtctaactgcttgaccttgcgtgttcactggggctcagaggctgagatccacaagttctccttaggcaagagctctgtgaatctgattgaggtgtcccaggcaaccgtcaagacagagctgaggaggactctgtctttaggtactgtggtctccactgcatataagccaccatctgtggccaagagcttggccccaattgtgtcccaggctacactggccagtagggtagccccaaacctaggccaggcatcagggttcagtaggctggccccaagcctatcccagcatatagcatccagtaaggtatccccaaggctaacctgcccatctatgggtaattgggtgaccccaaggctaccacactcctctgtgcctaatagagtgacaccaagaccagcacagccatctgtggtgactaggaggtccccaagccgaggacacccatcaaggacctttagagtggcctcagaccaaggtcaccaatcaatggctaactgggggtcccaaaacctagcccagccatctatggacagtggggagccctcaagcctagcccagccatctcaagcccctggggtaacctcaaatctggcccagccatctcaagcctttggggtgtctccaagtccagactacccatctcagtctgttggggagtacccaatgctggctcagccatttcagcccactgaggtgtccccaagtccaacctacccatctcaggccattagggagtacccaaccctggcacagccatttcagcccactgaggtatctccaagcccagcccacccatatcagctcactgaggtgtccccaagtgcagcctactcatatcagcccactgaggtgtccccaaacccaggctacctatctatggccattgagatgtccccaagcccagaatacccatctgtggccactgaggtgtccccaagcccaacctacccatatcagcccactgagatatccccaagctcaggctacctatctgtggccactgaggtgtccccaagcccaggctacccatctcagctcactgaggtgtccccaagctcaggctacctatctgtggccactgaagtgtccccaagcccagactactcatctcagcctactgagatgtccccaagctcaggctacctatctatggccactgaggtgtccccaagcccaggctacccatttcagcccactgaggtgtccccaagcccagactatccatgtgtggccactggggagtcccctagccttgcccagccatctcagcccactgaggtgtccccaagctcagcctacccatctgtggtcactggggagtctccaagcctggcccagtcatatcagcgcactgaggtgttcccaagcccagcctacccatttatggccactgagacagaagctgtccccaatccactccagaaaacagtgtctggaaacatggctccgagcagccgctgggacgccatgggccctaaaaattcctacagatccgtgcatggtaggattgttccagaactgctagaaagttctgtggccagggttaggcccttacagtatgtgcaaagacaaccatcccaggcctcagcccgaagtggtgcaaaccccacccacaggccctctgcagaggtaaggcccgtcatctgcactggggagatgacacactcctcggtcattcctccgctggccccgggagttcggagggtgtctctaggctatgagtcttccccaagtggttccctgccacccctttttaaccaggagtcaccgtggagacggcaggactcctatagcccccagaatcctgccgttagtcacaaggcatccctgaactccactatactccagggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctaaaaaaaaaaaa

SEQ ID NO: 601 - DNA, 3843 bp, Homo sapiens
  CDS (83)..(2245)
tatcctgcgtgatgttggacggccacaaatagattgctgatattgtgaggcagtgagacctaaggtaacctttatcaaaaggatggagttgggaaaaggaaaactactcaggactggactgaatgcgttgcatcaagcagtgcatccgatccatggccttgcctggaccgatgggaatcaagttgtcctaactgatttgcggcttcacagtggagaggtcaagtttggggactccaaagtcattggacagtttgaatgtgtctgtgggttgtcctgggccccacctgttgcagatgatacacctgttctactcgctgtccagcatgagaagcatgtcactgtgtggcagctgtgtcccagccctatggagtcaagcaaatggctgacgtctcagacttgtgagattagaggatcactacctatccttccccagggctgtgtgtggcacccaaaatgtgctattctgactgtgttgactgctcaggatgtctccattttccctaatgttcactctgatgattcccaggtaaaggcagacatcaacacccagggccgcattcactgtgcatgttggacccaggatggcctgaggctggtggtggcagtaggcagcagcctgcattcttatatttgggacagcgctcagaagactcttcacaggtgctcctcctgcctggtgtttgatgtggacagccacgtctgctccatcacagcaactgtggactcacaggttgctatagctactgagcttccattggataagatctgtggcttaaatgcatctgaaacctttaatatcccacctaacagtaaagacatgactccgtatgctttaccagttattggtgaagtacgctctatggataaagaggcaactgattctgaaacaaattctgaagtatcagtttcttcttcctatttagaacctctggatctaactcacatacatttcaatcaacataagtctgagggtaattctcttatttgtctaagaaaaaaggactacttgacaggaactgggcaagattcttcacatttggtccttgtgacctttaagaaggcagttaccatgacgagaaaagtcactattccaggcattctggttcctgatctgatagcatttaatcttaaagcccacgtagtggcagtggcttccaacacttgtaatataattttgatctactctgtcattccatcttcagtcccaaacatccagcaaattcgattagagaacactgaaagaccaaaagggatatgtttcttgacagaccaactattactaattttggtaggaaaacaaaaactcactgatacaacatttcttccttcttcaaagtctgatcagtatgccattagcttgattgttagagaaataatgttggaagaagaaccttcaataacatcaggtgaaagccagactacctactctactttcagtgctccgttaaataaagcaaatagaaaaaagttaattgaaagtctttccccagatttttgtcaccaaaacaaagggctgttgctgacagttaataccagtagtcagaatggaaggcctggaaaaacacttattaaagaaatccagagtcctctgtctagtatctgtgatggctccatagctctagatgctgagcctgttacccagccagcatcgctgcccagacacagcagcacaccagaccacaccagcacactggagcctcctcgtttgcctcaaagaaagaacttacaaagtgaaaaggaaacttatcagctgtctaaggaagtggaaattttatctaggaacctggttgaaatgcaacggtgtctttctgaacttacaaaccgtctgcataatgggaagaaatcctcttcagtgtatccactctctcaagatcttccttatgttcacatcatttaccagaaaccttattatctaggtcctgttgttgaaaaaagagcggtgcttctctgtgatggtaaactaaggctcagtacagttcagcagacttttggcctttctctcattgaaatgctacatgattcccactggattcttctctctgctgacagtgagggctttatcccgttaaccttcacagccacacaggaaataatcataagagatggcagcctgtccaggtcagatgtcttcagagactctttttctcacagtccaggtgctgtttcttctcttaaagtctttacaggccttgctgcccccagtttagataccactggctgttgtaaccatgtagatggcatggcttgatatctgcagtgtccttgctgtgtagctcttcagatgagaccattacaaacaaggcctgcttgacactggacactcgccaatgagactcccactgcactcaggcgaagcgcttgccatggtcggctctcctggtttccccgtttcccctgagctgaggctcgctgctgtgtagcagagctcagtctttattagatggctccgaaagtggtgtttatgtattcatgactgtgtggttttgactaagggcagaattctcagaacaaaacaatattatggtgccatatggatggtgttttatggtttctctgaggctttgtgtcccttgtccaaagctgcattgaagctgtcttaggagcacttaaaagataccttggcattgttataggtctttttcttggcttcaagaggaggttgaggagtctgctggggggcatgtgctctagcatattaacctcaaaccagcaagaattagcagagctccaaggaggaccagagacccactggcttctgctctcaggaacaggaagtggctctgatgttgcctggacctcccagaatttaaaccaaaccctcttgcttccttaacaaattctggctgacgaaggtccaggtactcttaaaaactggccctgggaaaattttgaatgaaatttcaagggaatttgtcccctctgggttccacttgaggttgtgccgatgctgctaccacactgtcgagcccaggtaagtcctactgcaggattttgtgctgtggccactcatgagtgtccctgaaataactttttttttttttaaatccagttttgggatcacgcaactttcctatttttctcccagtagtcagctcccttagttaacttgtcactttaatttgatatttttattttctctccttttaagtcttagagaccagcagagaatctgtgagagaaagtatttcaggaagttagaaattcaaccgaatctgaggtagtcctaaaaagtgccattttgtttcacttatgggctaaagtaccagcttagtcaggtaagagccctgacccacttcagatggtaacaccacttctcactgccttcagatggaatcacagatttcagtcacggcgcataacaaattgatcagtgagtggctaggcatctgcagataaattgtttcagccatagaagctccattagcacatatgcttccttttccccccttcctttaaaatcatctggaaagaaactattttgtgcccttggggactcctgtctgtctgttacagtttaccaagatggagctgggttaggaaagaagtgagggcccattttgtggttcaagtgcactagacagctgctggggtaggaagcacaggcaatgtctgtaatcagctgtgggagagcagtgactgagaacagtctgaggcctggctccacttggaagtatctggggtgcgatgaaatcacaattatcttgaagcctaaagagggaactacaagactgttaactaagatcaatgtgggcacctaaaagggtatgttaaaatcaccatttctcaggtcaaaatactgtgaataagtcttcaataaaatcactaatggttaaaaaaaaaaaa

SEQ ID NO: 602 - DNA, 1764 bp, Homo sapiens
  CDS (37)..(1314)
ctgacagcctgccaatgtgcctgtctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctcttctgccgtgcctcctccttggcccgccatgtactgcccaccacctccctgggccaccccctcactcagtgctccggctctctcctcctcctattccacgtcatccacatcatctcctgttctgggcgccccctcttaccctgcttataagcctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaaaaaaaaaaaaaaa

SEQ ID NO: 603 - DNA, 4683 bp, Homo sapiens
  CDS (261)..(3017)
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgcacttgagttgcatggacagaaaaagctctcctggacatttctgaacaagacccttcacccaggtggcatggcagaaggaggctgtttttttgaaaggagctggggccaccctggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccagggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccatttcagaggggaggctcaggaaggcttcttgcttacaggaatgaaggctgggggcattttgctggggggagatgaggcagcctctggaatggctcagggattcagccctccctgccgctgcctgctgaagctggtgactacggggtcgcccctttgctcacgtctctctggcccactcatgatggagaagtgtggtcagaggggagcaatgggctttgctgcttatgagcacagaggaattcagtccccaggcagccctgcctctgactccaagagggtgaagtccacagaagtgagctcctgccttagggcctcatttgctcttcatccagggaactgagcacagggggcctccaggagaccctagatgtgctcgtactccctcggcctgggatttcagagctggaaatatagaaaatatctagcccaaagccttcattttaacagatggggaaagtgagcccccaagatgggaaagaaccacacagctaagggagggcctggggagccccaccctagcccttgctgccacaccacattgcctcaacaaccggccccagagtgcccaggcactcctgaggtagcttctggaaatggggacaagtcccctcgaaggaaaggaaatgactagagtagaatgacagctagcagatctcttccctcctgctcccagcgcacacaaacccgccctccccttggtgttggcggtccctgtggccttcactctgttcactacctgtcagcccagcctgggtgcacagtagctgcaactccccattggtgctacctggctctcctgtctctgcagctctacaggtgaggcccagcagagggagtagggctcgccatgtttctggtgagccaatttggctgatcttgggtgtctgaacagctattgggtccaccccagtccctttcagctgctgcttaatgccctgctctctccctggcccaccttatagagagcccaaagagctcctgtaagagggagaactctatctatctgtggtttataatcttgcacgaggcaccagagtctccctgggtcttgtgatgaactacatttatcccctttcctgccccaaccacaaactctttccttcaaagagggcctgcctggctccctccacccaactgcacccatgagactcggtccaagagtccattccccaggtgggagccaactgtcagggaggtctttcccaccaaacatctttcagctgctgggaggtgaccatagagctctgcttttaaagatatggctgcttcaaaggccagagtcacaggaaggacttcttccagggagattagtggtgatggagaggagagttaaaatgacctcatgtccttcttgtccacggttttgttgagttttcactcttctaatgcaagggtctcacactgtgaaccacttaggatgtgatcactttcaggtggccaggaatgttgaatgtctttggctcagttcatttaaaaaagatatctatttgaaagttctcagagttgtacatatgtttcacagtacaggatctgtacataaaagtttctttcctaaaccattcaccaagagccaatatctaggcattttcttggtagcacaaattttcttattgcttagaaaattgtcctccttgttatttctgtttgtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcaaaaaaaaaaaaa

SEQ ID NO: 604 - DNA, 1453 bp, Homo sapiens
  CDS (30)..(1073)
ccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataaggtaattcagtccagtggtttttcagactttttctatccacatcatcacagcatttacaagcgtaacctgctgccatcagcaatgggtcctattacctgtactaattctcaaggcagtagtcacactgcttccctgtacatcatgggggagttggatgtccaaagtaccaggcacagaaaccctaaccaagtggctgataacctaatcaaattgagagcatttttcacatctcataatggacttgaaaacaattataaatctgaaataagtgagaataaaaagaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggctatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctgggggctgaagctggaggagaacctccaggagacccactctgctgtcttgtag

SEQ ID NO: 605 - DNA, 1415 bp, Homo sapiens
  CDS (29)..(784)
gaggctgcgcccgcccgcgcccggggtgatgcagttgccccccgcgctgtgcgcccgcctcgctgcggggcccggggcggcggagccgctgcctgtagagcgggatcccgcggctggggccgcgccctttcgcttcgttgcgcgccccgtgcgcttcccgcgggagcaccagttcttcgaggatggggacgtgcagcgccacctctacctccaggacgtgatcatgcaggtggccgacgtgcctgagaagcccagggtgcccgcgtttgcctgccaggtggccggctgctgccaggtgttcgatgccctggacgactacgagcaccactaccacacgctgcacggaaatgtttgctccttttgcaagcgggccttcccttccggacacctgctggacgcccacatcctggagtggcacgattcgctcttccagatcctgtctgagaggcaggacatgtatcagtgcttggtagaaggctgcacagagaagttcaagaccagcagagaccggaaggatcacatggtgaggatgcacctgtaccccgcggacttccggtttgataagccaaagaaaagcagaagcccagcctcagcagaagccccaggggacagtggagagcggtcagaaggggaggccatggaaatctgctctgagcctgtggcagcctcccctgcaccggcaggtgagaggcggatctacagacatagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtcatcactcaccacatcgacctaagtatccaccactgcaccaccaccccccccaccaacaaccacacccccaccaccacaacaacccgcccacgcacaccacgaggcaaaagcacgcgccccaacgggccccaaaccgacgccaccgcgaacaccacaacaacacagtgcacccagcaggcggccacaaaacaagccgagggcacaccccacataaagaggccgcccgccgacacaaccgcgaacaacgacccggggtccaccgggatgaccaccacacgaccgcaaacaaacaaaccaacgagcggccacaacacaagcacacgcccaccaccgaaaaccaaccacaacgcgacaaccaacacgacga

SEQ ID NO: 606 - DNA, 891 bp, Homo sapiens
  CDS (104)..(775)
aaggatccttaattaaattaatcccccccccccggggcggcccagcggatcgtgccgcggcggccgagcgcagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggtctcccacacattctccaactacccgcccggcgtccgctacatctggtttcagcacggcggcgtggacactcattactgggccggctggtacggcccgagggtcaccaacagcagcatcaccatcgggcccccgctgccctgacaccccctgagcccccatctgctgaaccctgactggtaaacaactgctgtcagaaaagggctgggcttgggaaggggaggtggaggccaggtgtccccagacctctaacccttgcccctagcaggctcttctttgtggagcctct

SEQ ID NO: 607 - DNA, 750 bp, Homo sapiens
  CDS (134)..(679)
aaggatccttaattaaattaatcccccccccccccccccggccagacgcggagggaaggagctacgagtagccgccgagaggccgcggagccagcgacgaccgacccagccgagccgccgccgccgcgcccccatggcggccgccaaggacactcatgaggaccatgatacttccactgagaatacagacgagtccaaccatgaccctcagtttgagccaatagtttctcttcctgagcaagaaattaaaacactggaagaagatgaagaggaactttttaaaatgcgggcaaaactgttccgatttgcctctgagaacgatctcccagaatggaaggagcgaggcactggtgacgtcaagctcctgaagcacaaggagaaaggggccatccgcctcctcatgcggagggacaagaccctgaagatctgtgccaaccactacatcacgccgatgatggagctgaagcccaacgcaggtagcgaccgtgcctgggtctggaacacccacgctgacttcgccgacgagtgccccaagccagagctgctggccatccgcttcctgaatgctgagaatgcacagaaattcaaaacaaagtttgaagaatgcaggaaagagatcgaagagagagaaaagaaaggatcaggcaaaatgatcatgccgaaaaagtggcggaaaagctagaagctctctcggtgaaggaggagaccaagggaggatgctgaggagaagcaataaatcgtcttatttta

SEQ ID NO: 608 - DNA, 2304 bp, Homo sapiens
  CDS (667)..(1782)
cctttatttacatatttaagctaggaactactattttgttttaattgcgtacattttgcttggaaatcacaggaagaaacacaacaaagcattgcccaaggtacagaaacaataataaacgtacttaaaactcatttaaattccagcatttttctccttattttagaagtttaacatttcagaagcagacactgcctcccttcctgcaacaactttctcctcttaagtctcatttttccccagtttcaagggcgaattctagaactccccggaaccgccaccagttaaccagaattccgtggctttggaaaataaaactgctgttatagctcttctgggtatttgagaaatgcacttgtgaagggttagagttgaatcttttgatgcgaaagtcgggttttcctgatactgggattcctgggattccaggtgttggggtggcccaattcctgcgagaagcaatagcgggcggtaacatgaggagcacggtgcgtccagcgagtccttccgcctggggccctgccgaccccctgcctgcgcccccaggactctggcctcacccggccgtgccggggcctctgtgacgcggcgttccaggcactcggccccggccgagcccgtagctagagcggctcagagacaggaggcggcggcagcagcggcggcatgaaccactgccagctaccggtggtgatcgacaacggctcgggaatgatcaaggcgggcgtggctgggtgccgggagccccagtttatctacccgaacattatcggccgcgccaagggccagagccgcgcggcccagggcgggctagaactctgcgtgggcgaccaagctcaggactggaggagctcgctgttcatcagttacccagtggagcgtggtctcattacttcatgggaggacatggagatcatgtggaagcatatctatgactataacctaaagctgaagccgtgtgatggcccagtcttgattactgagccagcgctgaacccactggccaaccggcaacagatcacggaaatgttttttgagcatctgggtgttcctgccttctatatgtccatccaggctgtgctggctctctttgctgctggcttcactactggccttgtgctgaattcaggtgctggggttacccagagtgtgcccatctttgagggttactgtctgcctcatggtgtgcagcaactggatctggcaggccttgacctcaccaactacctcatggtgctaatgaagaaccatggtatcatgttgctcagtgcttcagacagaaagattgttgaagacatcaaggagagcttttgttatgtggcaatgaactacgaagaggaaatggccaagaaacccgattgtctagagaaagtttaccaactacctgatgggaaggtcatccagctccatgaccagctcttttcttgtccagaggccctcttctctccgtgtcatatgaaccttgaggcccctggcattgataagatatgcttcagcagcataatgaaatgtgatacaggcctgaggaattccttcttttccaatattatccttgccgggggatcaacctctttccctggtttagacaagcggttagttaaggatatagcaaaggtggctcctgccaacaccgctgtgcaagttatagctcctccagaaaggaaaatatcagtgtggatgggaggttctattcttgcatccttgtctgccttccaggacatgtggatcactgctgcagaatttaaagaagttggacccaacatagtacaccaaagatgcttctgaaatacagataaaatggttggaagaaaatgttttgagtatatgtgacagaaaactttggatattatatgtttctgggagaagagaaaatacttcacctattgggatgccaatatttctgttgtatttctataatgggtttgggggataataatggtgaagctcaagaacagatgtctattgagtagaaccaagttaaaataatgtttcccatagtgtttcttctataacttgacgttggtgagcttatatttcccttggaagagagcatttgtggtacaatatgctatgtgccaaatgagtgataagatttaagcttattgaagtttagggaaagaaggttgctgtggtgaggaacgagactccatagcagaggtatgccatcatggaaggggtggcattgggatggagcgcagatatccaggcaagcatactaaaatgaacaagttgctaaagatgagaatgaacaaagcatattcagggcatgtttaatagactgattttgtttttaaaaaaaaaaaa

SEQ ID NO: 609 - DNA, 1581 bp, Homo sapiens
  CDS (160)..(1578)
cggaatttccgggtcgacgatttcgtcgggcttcttccccatcacaccctcctagttgccctggtgactgtgtgacccctctcccccctccaccgcctgctgccacggccggccgtataaatagaggcgaggagcagctgggctctcttggcagtcaccatgagggcgctggtcctgctcggctgcctcctggcctcgctcctgttctcaggacaagcagaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactag

SEQ ID NO: 610 - DNA, 1834 bp, Homo sapiens
  CDS (895)..(1746)
ctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtgttggcagcggctctgatgagcccgagaagaggcctgcccttgggtgcggagtctccctgcgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagcttttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaaatccagcagaaaagtcattactacagagatcaggagaaagcggtcgaggcgttgaacgcaacggccggtgtatgacgggacaccgggcgaggatcagggggaggggtgcgaagggcagcctccggggagaggctgccgggctgacgggcagcaggcaagt

SEQ ID NO: 611 - DNA, 2835 bp, Homo sapiens
  CDS (49)..(1710)
atatgatcagtaaacctgcctccctccttgtggccctgggaggaagccatggactctaccaagtctgaacccctgaagggatcaccagaggctgaagatggaaacattgaatataaattgaagctggtgaatccatcccagtaccgctttgagcacctggtgacacaaatgaagtggcggctccaggagggacgtggtgaggccgtctaccagattggggtagaggacaatgggctgctggtggggctggctgaggaggaaatgcgagcttcgctcaagaccctgcaccggatggcagagaaggttggggcagacataaccgttcttcgagagcgagaagtggattatgatagcgacatgccccggaagatcaccgaggtgctagtacgaaaggtccctgacaaccaacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaaggaagaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattgctggcaccacaagggaacatctggggctggccctggccctgaaagtgcccttcttcatcgtggtcagcaagatcgacctatgtgccaagaccacagtggagaggacagtacgccagctggagcgggtcctcaagcagcctggctgccacaaggtccccatgctggtcacctctgaggatgatgccgtcactgctgcccagcagtttgctcagtcacccaatgtcacccccatcttcacattgtccagtgtgtctggagagagtctggacctcctcaaagtctttctgaatattctgccaccactcaccaacagcaaagagcaggaggaactcatgcagcagctgacggagttccaggtggatgaaatctacacagtaccagaggtggggactgttgttggaggaacactttccagtgggatttgccgtgagggggaccagctggtggtgggccccacggatgatggctgcttcctggagctgagagtatgcagcatccagcgcaaccgctctgcctgtcgtgtgctgcgagctggtcaggctgctacactggcgcttggggactttgaccgtgcactgcttcgcaagggcatggtgatggtgagcccggagatgaatcctaccatctgctcggtgtttgaggcagagatagtcttactgttccatgccaccaccttccgacgaggattccaggtgacagtacacgtgggcaacgtacgtcagacggcagtggtggaaaagatccatgccaaggacaaactgcggacaggcgaaaaggcagtggtacgtttccgcttcctgaaacacccagagtacctgaaggtgggcgccaaactgctgttccgggagggtgtcaccaagggcatcggccatgtcactgatgtacaagccattacagcaggagaagcccaggccaacatgggcttctgaacccttcaggcagggacagttctattgctgtccctacaatatataaggtgacttctggccatgctgccctgccattggcggctctgtgtgttaataggctagggagagaggggtgctgtctgccacttgctccctgccaactttctggagaggtgccaaacttggtgtggccaggaaagggcagtcctgagggagaagacaggattcagggcagtgctccgaagctgtgtgctcacctggttggctcatcaaacctggcaaccctgtggcctgtctgccggagctgactggatccactcatcaattcttcgtccccactactaagactgggcatgttttgctggtgtggtctctgcacttcaggaatggtcacaacagggggtagccctcaaaagcactcctttttctatacctcttctcaaggccatgtaagttgcccatctctacctggctgtggacaaaaggttatctgctcttggccatctggtggtggtggcggcccagagtctgaagaaatggcacagggacagtgaatggtagtgttgccaccctgtgctgaggcctgaggcctcttcctcagctttatctccctttccttcactcaagggccatttccccagtccctatctcccccatcccctcccggcttataggccccacaggtgctatttgttgtgctggcccaggcgtggggctaccaagcaaaggcttggcatataccaaaggccagctgcatgcccatcagtctggtctttttcctctgcggtcatgttggctttcatgctggatcaaatgttttactttcccagactggtggcatctgagttccccatcctaccactctcaccccactttcctgccccacctaaaccctcgttttagtaatttgtagtgactgttcccttccctctgttgcagggaaccaggaggaaagggaaagatgttgccatatttcctactctttaggcatggactctcctttccctttgttagtgtcctgggttcccatggactcagggatttgttggctaaggtttctctgtgcatatatatatatatacatatgtatatatatttaaatacacatatatattgtacagctcgtgccgaattcggcacgag

SEQ ID NO: 612 - DNA, 1044 bp, Homo sapiens
  CDS (117)..(389)
ctccggggtaggtgggtgacggcgggcggaggtgtacgagggagccgtggaggtccaagtgagtgcttatgaaactgcacagcatctgatgaaactagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacaggtatcaagctttaagacacattgttgatgtattgaatgtgaaaaaaacccagtgcactgtaggatctttgaactgttacgctagaaaggaaattatgctagaaaggaaatcaaaaataattctgtttgagattagttcacagaacacaaaactatatttaattgctcaggtagtatcctgtggttcaataaagcaaaaattatttccatgcatttgccctgacccataattaagttagttctcagaaaatgcttcctgagtaattatttcctggccttccggggctgactgcgtggaacatgcaggctcattcaagatgtgaggtgtcctgggggcacatatttatttccctgcttatttaatggaagttattacttagctaaaagtataaggctttatttgcctgaaaaagaattactttaaaatagcctcaaaataataagctagtttttagcagcgtgaaaacctgaggtgagaaatccagcataatgggtcttttgcctcaagttaaatatgcacagtatttgacatactatcagaatgttactgagagttaatctgtaaggccctgtaattggggagtaagtgaaaacttcagggttaaataaagagccaactaccgcaaattcagttgaacttcacagctagattctagttggctttttcttctctttcctct

SEQ ID NO: 613 - DNA, 5203 bp, Homo sapiens
  CDS (63)..(2894)
tttcgtctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggacttttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataaaaaaaaaaaaaa

SEQ ID NO: 614 - DNA, 647 bp, Homo sapiens
  CDS (165)..(302)
ggcgcaccacaaaacgctccgcgggctctggacaccctatcagctagtcccgtccctcctggtgtccgggctcgaccatccatcccgtgttttgggagtgcctttccttaccagattcttctaaagccctgatgcacccacccttaagtggaaggttttgaaacatgaatctttcgctcgtcctggctgccttttgcttgggaatagcctccgctgttccaaaatttgaccaaaatttggatacaaagtggtaccagtggaaggcaacacacagaagattatatggcgcggttggtaacatctgaaactgtccagagggactctggagagaatggtcctcgctgttgggagttgatagccagagagtagcttctagacaccagaccttaccaggcaataacctaacagcacccattataggtgcaatatgggcatatatctccattgtgtcttggcttggagaacagctcccagagaagtatcaacccatccctggccatggtttctcttccatttctgcccgcaaatcggcttggtgaacatgggttgggtaagtagacataaagtccaccagctatatgtttgcctctagaatgaagaaggatggaggagagcagtgtgggaaaagaatatgaaaatgattgaac

SEQ ID NO: 615 - DNA, 1701 bp, Homo sapiens
  CDS (24)..(1421)
tttgttattgataatagttcttcatgaaagcaacgcaacttgaacagatgaaggaagattattcatacattatggaaacgaaagaaagaacaaaggagcagatacatcaaggagaagagcggcttactgaactaaagcgccagtgtgtagagaaagaggaacgttttcaaagtattgctgggttaagtacaatgaagactaatttagagtccttgaaacatgaaatggcttgggcagtggtcaatgaaattgaaaaacaattgaatgccatcagagataatatcaaaattggagaagatcgtgctgctagacttgacaggaaaatggaagaacagcaggtcagacttaatgaggcagaacaaaagtacaaggatattcaagacaaactagaaaagattagtgaagagacaaatgcacgagcaccagaatgtatggcattgaaagcagatgttgttgctaagaaaagggcctataatgaagctgaggttttatataaccgatccttaaacgaatataaagcattaaagaaagatgatgagcagctttgtaaacgaattgaagagctgaaaaaaagtactgaccaatctttggaacctgaacggttggaaagacaaaaaaaaatatcttggttaaaagagagagtaaaggcctttcaaaatcaagaaaattcagtcaatcaagagatcgaacagtttcagcaagccatagaaaaggacaaagaagaacatggcaaaattaagagagaagaattagatgtgaagcatgcactgagctacaatcagaggcaactgaaagaattgaaagatagtaaaactgatcgactcaaaagatttggccctaatgttccagctcttcttgaagccatagatgatgcttatagacaaggacattttacctataaacctgtaggccctttaggagcttgcattcatcttcgggacccagaacttgctttggctattgaatcttgcttaaaagggcttctgcaggcctattgttgccataatcatgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaataagtgacttggagaatgaggtgaaataggaggcccgatattaaatttcaggaaattatctggctggaaagcattttaacaccggaggaactctaaaggggccagtcctttatagacctggagaagcaagagagggggcgataaatctcccggagccaaaatagcacacctatgacacgagcccactgaagaaaacatacacgcggcacacaacccgaacaacatatacagaaccatagggagagcaccacagacagaacatcgacacacagacctcgagccaacgtagcgtgagcgacaagcaaa

SEQ ID NO: 616 - DNA, 1830 bp, Homo sapiens
  CDS (337)..(696)
gcacgagtttagattagcagctttatgatgccgatgctgaaggaacttttcaccccattcttacaagtctgctactgttttaagtgacatccttatagttgtagataagcaaatgtaaggttatatcaatgtgaagaagcccttagtatcacattttaaaatttatcatttagcaatatgacttttaaatttattgtttccgaatgagtgttgttgaggaatgttagcagtagtaaaatcttgtgttacaagatttttgcatttacatgaactttcactcatttttcagaatttgttcctagagacagagaacccaatacaaaagtgagaacatgtatgcataatcagaaggatgcagtgcagatgcctagtgaaactctgaaagcaaaaatggtacctgagaaagttccccgcagatgtgctactgttgctgcaaataaaataaagataatgagtaatctaaaagaaacgatctcaggaccagaaaatgtctggattaggaagagtagcagaaaactgccccatcgaaatgcttctgctgcggctaagaaaaaattactgaatgtttataaagaggatgatacaaccataaattctgaaagtgaaaaagagctagaagatattaatagaaaaatgcttttttttaagggggttcagatcctggaaagaaaatgcacaatagtgactatgagaatgtagaagtggcatctgaaaacaattggtacacaagtaaactggcagttacattctgctcccagctctaaaattactcccttattggcatctttggaggaattttctaaaagccataatccagtgggttcctcccagtcagctcttgtacagacatgtgctctggggaattctgaggaggaaataaattgcagagtctgtaggtggagaggtggaaagaaaagacaaatggcctgctataagactactattcctttccagaatgcaaggccttgaagacatgattccttagaggaagaatataatgggaagtgtacaggctaggaagaacttgaagtgaacaaatttcaaaatcttaacctgatgctaatttttcagggttctccattacagtgtaaaaattcagaccacgacaactatggtgtcatgaggaaaaaaaatcaggcatttttccaaaggaagtgctaatgggcctatttgacttctgagtgaagcaaaaactacccagatccattccctataattcacatccccaaaggtcaaaaacaaactaggaggacctgggaatttcagctggagatactgattattgagttctgaagtagagtgttggaaataggcaattagagaaagtccattgatgtcattttgtttataatattgcagttcatactgaatgaccacttgatatgactaattcagggaatatatatttttctatgaaagctatgaatgttactatcacggcttttccttatttttacttgtatgtagcagcatttacagaaatgccaaaaatgtgcctcattaagaggcaggtcttaatcagttagataaaaataaaatgtatagcttaagatcaaaacagtcatatttttagatacagtgaaatcttttatgtttctctacagcaccttaaaaattagaacttgaatactttgagtaaacttactacaatctcatcccaacaaactttaatggtagcatgtttggcctatttcattgtggcctgtactaggattagaaaatttggtcgtggtataacaaagaagtgtatttacaataggatttaatttgttgttaatatgtatttgttgaaattaaaattgccagattaaatgaaaaaaaaaaaaaaaa

SEQ ID NO: 617 - DNA, 2322 bp, Homo sapiens
  CDS (170)..(751)
gtgtatctcatgcgagtctgcgaactgaagccgctggtgctatgcaagcgtctgtggctcgaatggcctagcccggcggaagcctgacccgccccatgctcagtggtgtggttcgcgccaagccccgtgccctggacccagctggacaggtgtctccaagaagcagctcatgtggcttctgaaccgactacaaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccttgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggcttaccatgtaggggaggggagatctatccacatacctcaggtaacagggaggtgcgcgggtggggggagggctgggcggaccaaaggccggaggggtggggcctggggatagcgagaggcttgagaatggggccgcttgggggagggaagaggcagcccggcgaggggcaagcgggggacccagccgggctgggcccctgggccccgggtctgtacaatacggtttgctataaaactcaaaatcttccagccgggaaaaaaaaaaaaaaa

SEQ ID NO: 618 - DNA, 1525 bp, Homo sapiens
  CDS (317)..(1264)
cggacgcgtgggcggtttcgtgggctttacttggcccgcgcttagggccctcgcggggggcttgtgggtcctcctccccctcccactgacaactgccccaactgctcttcccgccccggtcacagtgaaaatgtagacggggtcgttgtccgtacgactgtgcgccagggctcggggaggggcgccctccgcgtgagcgcccccctgggaatattgaacataatcacctctcattccagactatgttaggtcttaatggtgggaggacgcccgagtgctcggcccgtttcaccccgaggaggaaggacactgggtcatgacgccatcagagggcgccagagcagggaccggacgcgagttggagatgttggactcgctgttggccttgggcggcctggtgctgcttcgggattccgtggagtgggaggggcgcagtctcttgaaggcgcttgtcaagaaatctgcactgtgtggggagcaagtgcatatcctgggctgtgaagtgagcgaggaagagtttcgtgaaggttttgactctgatatcaacaatcggctggtttaccatgacttcttcagagaccctctcaactggtcaaaaactgaggaggcctttcctggggggccgctgggagccttgagagccatgtgcaagaggacagatcctgttcctgtcaccattgctctcgattcactcagctggctgctacttcgccttccctgcaccacactctgccaggtcctgcatgctgtgagccatcaggactcttgtcctggtgacagctcctcagtggggaaagtgagtgtgctgggcttgctacatgaagagcttcatggaccaggccctgtgggagctctcagcagccttgctcagactgaggtgaccctgggcggtaccatgggccaggcctcggcccacatcctgtgtcggaggccccgacagcgcccaactgaccagactcagtggttctccatccttccggacttcagcctggatctccaagaggggccctctgtagagtcccagccctactccgatcctcatatacccccggtggatcccacaactcatttgacctttaaccttcacctgtccaagaaagagagagaagccagagatagcctgatcctgcccttccagttcagttctgaaaaacagcaggctctcctgcggcctaggccagggcaggctaccagccacatcttctatgagccagatgcttatgatgacctggaccaagaagacccagatgacgacctggatatttgactggccagatttgattagattgtaattggagggggcgcgggaagactttgggcccagaaccatctttctattgtttgtgttagccttaccctgtccctgccccaccttggttccccttgtctatggagccccgccttgtgagccaggaagcagcgtctcatcaggacagaaggtaggatgaagacatggggtaatgtgagagagtagaacacccccgtacctaataaaaatctttatttttttattaaaaaaaaaaaa

SEQ ID NO: 619 - DNA, 1825 bp, Homo sapiens
  CDS (162)..(887)
tccacccgagccccctcccccgggccgttcccgagttctaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattctaaaaaaaaaaagcaaactataacaagcaaaaaggcagacactgaagctcacaaactccaactaacatatgccttcttagttggcagacatgcttgcaaaactcctgatggctttgatatttaaaaaaaaccctagagaggggtttgtttacctccggtcaaattttgcacgtcacagacaccggattttggcacatggctaccccccgggggaccggcaacatgttgtagat

SEQ ID NO: 620 - DNA, 2728 bp, Homo sapiens
  CDS (119)..(2263)
tttcgtaaggaagtgagaggtcggctgggggttctcatagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctgctgacgcttctgctggctacagctcagagctgggttccccagccaggagtgaaggctgggggctcctatcagcaatggaccttcccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgctaagggcaaaaaaaaaaaaa

SEQ ID NO: 621 - DNA, 1628 bp, Homo sapiens
  CDS (79)..(1467)
tcccgaattcccgggtcgacgatttcgtgggtcaagtggcttcttctgagcgctgagggaggggagcgtgcgtaggggatggtgccagcgctgcgttatttggttggtgcctgcggacgggcccgcgggcttttcgccggtggctcccctggggcgtgcgggttcgcgtctgggaggccaagaccgctgtgtggaggtagccgcagcgccagcaccagctcatttgatatagtcattgttggtggcggaattgtggggcttgcctctgccagagcactcatcctgcgacatccatcactttctattggtgttctggaaaaggagaaagatttagctgttcaccagactggacataacagtggtgtcatacatagtggaatttattataaacctgagtctctgaaagccaaattatgtgtacaaggtgcagccctcctctatgagtactgtcagcaaaagggaatttcctacaagcagtgtggcaagcttatagtagctgttgaacaagaagaaattcccagacttcaggccctatatgagaaaggcctccagaatggtgtcccgggcctgaggctgatccagcaggaggatataaaaaagaaggagccatattgtaggggtctaatggctattgattgtccacatactggcattgtggactatcggcaggtggctttgtcatttgcccaggatttccaagaagcaggtggctctgtcttgaccaattttgaagtaaaaggtattgaaatggctaaagaaagtccttcaagaagtatagatggaatgcaatatccaattgttataaagaatacaaagggagaggaaattcgatgtcagtatgttgtgacatgtgcaggactttactcagaccgtatttcagagttgagtggctgcactcctgatcctcgaattgtaccattccggggagattacctgcttttgaagccagaaaaatgttatcttgtaaaaggaaatatttatccggtcccagatagccggtttcctttcctaggagttcacttcacaccaaggatggatggcagtatttggctagggcctaatgcagttcttgcctttaaacgagagggttacagaccctttgacttcagtgccacagatgttatggatataattatcaatagtggcttgattaaactggcatcccagaatttttcctatggagttactgaaatgtataaagcatgttttcttggtgcaacagtgaagtatcttcaaaaattcatccctgaaattactatcagtgatatacttaggggcccagctggagtaagagcccaggccctggatagagatggaaatctggtagaagattttgtatttgatgcaggagttggggatattggaaatcgcattcttcatgtgagaaatgcaccttctcctgctgctacttcttccattgcaatttctggaatgattgcagatgaagtacaacaaagatttgaattataaataatgaaaggagctaggtatgcactgtaatcttcatgtcagcaacaagaatgtactaattgcattctttaatttaaaaaatggtttttaaactttcgtttttaggtcaaagataaccactgcattgttaaaatgatgtaacatagaaataataattt

SEQ ID NO: 622 - DNA, 1762 bp, Homo sapiens
  CDS (131)..(1582)
aaggatccttaattaaattaatcccccccccccgagctctgggcacctccagctcctgctcgccggacggctcccagggagagcagacgcgccagacgcgccaccctcggggcgccgacggtcacggagcatggggtcggcctttgagcgggtagtccggagagtggtccaggagctggaccatggtggggagttcatccctgtgaccagcctgcagagctccactggcttccagccctactgcctggtggttaggaagccctcaagctcatggttctggaaaccccgttataagtgtgtcaacctgtctatcaaggacatcctggagccggatgccgcggaaccagacgtgcagcgtggcaggagcttccacttctacgatgccatggatgggcagatacagggcagcgtggagctggcagccccaggacaggcaaagatcgcaggcggggccgcggtgtctgacagctccagcacctcaatgaatgtgtactcgctgagtgtggaccctaacacctggcagactctgctccatgagaggcacctgcggcagccagaacacaaagtcctgcagcagctgcgcagccgcggggacaacgtgtacgtggtgactgaggtgctgcagacacagaaggaggtggaagtcacgcgcacccacaagcgggagggctcgggccggttttccctgcccggagccacgtgcttgcagggtgagggccagggccatctgagccagaagaagacggtcaccatcccctcaggcagcaccctcgcattccgggtggcccagctggttattgactctgacttggacgtccttctcttcccggataagaagcagaggaccttccagccacccgcgacaggccacaagcgttccacgagcgaaggcgcctggccacagctgccctctggcctctccatgatgaggtgcctccacaacttcctgacagatggggtccctgcggagggggcgttcactgaagacttccagggcctacgggcagaggtggagaccatctccaaggaactggagcttttggacagagagctgtgccagctgctgctggagggcctggagggggtgctgcgggaccagctggccctgcgagccttggaggaggcgctggagcagggccagagccttgggccggtggagcccctggacggtccagcaggtgctgtcctggagtgcctggtgttgtcctccggaatgctggtgccggaactcgctatccctgttgtctacctgctgggggcactgaccatgctgagtgaaacgcagcacaagctgctggcggagggcctggagtcgcagaccctgttggggccgctcgagctggtgggcagcctcttggagcagagtgccccgtggcaggagcgcagcaccatgtccctgccccccgggctcctggggaacagctggggcgaaggagcaccggcctgggtcttgctggacgagtgtggcctagagctgggggaggacactccccacgtgtgctgggagccgcaggcccagggccgcatgtgtgcactctacgcctccctggcactgctatcaggactgagccaggagccccactagcctgtgcccgggcatggcctggcagctctccagcagggcagagtgtttgcccaccagctgctagccctaggaaggccaggagcccagtagccatgtggccagtctaccatggggcccaggagttggggaaacacaataaaggtggcatacgaaggaaaaaaaaaaaaaaaaaaaaaa

SEQ ID NO: 623 - DNA, 1238 bp, Homo sapiens
  CDS (106)..(813)
gggacctcaccacctgtctcctccctgaggtcttagaacagatacaagaaattccaggcgaaggtcccacagagtttggatcacgatgaggccagtgagtcggagatgagaaagacctcaaactcctgcatcatggaaaatgggcaccagccggggacagagaagaattcctctttcacgtggtctgtgccaagctctggctacggggcagtgacagcaagcaaacacagcaatagcccaccgctggtgacaccaccccagtcgcccgtgtccccgcagccgccagccataactcaggtccatcggcagggggagcgtcgcagggagctggtgaggtcgcagacgctgccccgcacctcggaggcgcaggcccggaaagcattgtttgagaagtgggagcaggaaacggcggccggcaaggggaaaggcgaggcccgggccaggctgaagcggtcgcagagcttcggcgtggccagcgccagcagcatcaagcagatcctgctcgagtggtgccgcagcaagacgctgggctaccagcacgtggacctgcagaacttctcctccagctggagcgacggcatggccttctgcgccctggtacactccttcttccccgatgcctttgactacaactccctgagccccacgcagaggcagaagaacttcgagctggctttcaccatggccgagaatctggccaactgtgagcgcctcatcgaagtggaggacatgatggtgatgggccgcaagccggaccccatgtgtgtcttcacctacgtccagtcgctgtacaaccacctgcgtcgcttcgagtaaagcccctgagcctggattgccaaagagcagccccaggaagaggccgggggtccgcttgcgattccccagccaggatgcccccaggagccttgccgtttggtgtgagcgcgctgtttgttctgtggcatgtgacggcactccccttcgagcccagctgtgttactgattaaaagtactgctgagctgtggtccgacagcactgatcacagccaagggcttggaggaaaaggaaaaattatgagagagagagagcccttggtgctaagtaatgatcttcctaaagaaatgcttgtgtttatagcttccagaatgctaatctacaattttccctctggtgaattcgatacatcggctttacagggttacagtgattaccaagtgttttttttttatcaaaatacccagagttttttacttcctca

SEQ ID NO: 624 - DNA, 730 bp, Homo sapiens
  CDS (1)..(660)
atggcctccgcgggcagcaccgctcggcgggcgggctccggaagctggcactcagaaaggggagaagggagaggtgctcggccgcagccaactccaagtggctccatgcagcaggcgaacaaagtctccttgaaggccacctggactgacgcggagtccaagcagcccaggtgggtagcgggagaaggtgtcccggctgcggggagcgagaacccggcccagcgcctccctggtgggcagggcctggagcgggcgggggcggaggctgcggcccgagaagcccgcagagacaggctggggccagggatcgcctcccgagaggtgcctaggccgtggcccagagtcgcttccccactgccccgcccaccagccaggcgggggccagggatcgcctcccgagaggtgcccgggccgtggcccagagtcgcttccccactgccccgccctccagccagcccctgcccgacctcgcagaccacctcagtgcgcaggcgactgccctcgccaggccgcgccgccctgcctcgctcaccccgccccgcgctgaccccagccccagcaaggagtccgaccagacggcaatcgaccagacggcgatcgggagctactaccagctgttcgcagcggctgtgggcaacgtggaatggctgcgattctgtctgaaccagagcctcagggaaatccccaccgacgacaagggcttcactgccatccacttcgccgcccaatg

SEQ ID NO: 625 - DNA, 1548 bp, Homo sapiens
  CDS (123)..(1382)
tttcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaaaagttttggatgaatggaaggaatataaaatgggagtaccaacatatggtgcaattattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgccgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaattcgaggcattttaatgcttggagaaagactataagtgaatctacttcaagggattctgttcatggtggtatacagttcttggtgctcttttggaaattgtcaaacatttactgat

SEQ ID NO: 626 - DNA, 2394 bp, Homo sapiens
  CDS (235)..(1965)
tttcgtcggccccctatcccataccagttgcctgttagcccaacttcactatgctttctctctggtgctcctggcccagagcacaagcccagtgcagggagggagggtaactgctgacttcacgtctctgcccctccccaggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcagccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggagggtagtgg

SEQ ID NO: 627 - DNA, 1017 bp, Homo sapiens
  CDS (87)..(935)
  misc_feature (1)...(1017): n = a,t,c or g
gagggagncggggagatagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccactatgatgagagaagccacctgcatgacaccttcacccagatgacccatgccctgcaggagctggctgctgcccagggatcctttgaggttgccttccctgatgctgcggagaaaatgaagaaggtcattacacagcttaaagaagcccaggcttgcatccctccctgcggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggaggtctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacgtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggatgttctttcgatggtactgcagtggcaactaacaaaggtatctttcctccttccctatcctatttccatcctgaaaataaagaatatatttcaactcaaaaaaaaaaaaaa

SEQ ID NO: 628 - DNA, 2467 bp, Homo sapiens
  CDS (51)..(2129)
caacttcttggggctcacccactctgcaggccacacattctttcctgacaatgtcccctaggcaaacccaagcttctttgatctcaccttctcggccggcctctactccccctgattcaccccctctgcaggcccctctttcccttcctgcctcaccccctctgcagacttctctctctcctgctgtctcacccctaagctcacccctgaccatacaccctctgcaggcgctatcttctctggcctcccactctcctcaggcacctctctcttccctgatcatgccccctctggagacccaatcttccctagccccaccctctctgcagacacctcctgcttccctgaccacaccccctctggagaacctaccttctctagccccgcctcctctgcagacagcttctgctcccctgaccacaccccatctggagactccaccttgtccagccccatgccctctgcaagcaccaccttcgccattgaccacgccccctccggagatgccctcttccatagccacgcctcctccacaggccccacctgctctggcctcaccccctttgcagggcctgccctctccccctctgtctcctttggccacgccccctccacaggccccacctgccctggccttgcctcctctgcaggcccctccctctccccctgcctcaccccctctgtctcctttggccacaccctctccacaggccccaaatgctctggcagtgcaccttctgcaggcccctttctctccccctccctcacccccagtgcaggcccctttctctccccctgcctcacccccagtgtctccttcggccacgcccccttcacaggccccaccctctctagccgcacctcctctgcaggtcccaccctctccccctgcctctcccccaatgtctccttcagccacgccccctccacaggccccaccccctctcgctgcgcctcctctgcaggtcccaccctctccccctgcctctcccccaatgtctccttcggccacgccccctccacgggtcccaccccttcttgccgctcctcctctgcaggtcccgccctctccccctgcctcactcccaatgtctcctttggctaagccccctccacaggccccacctgctctggccacacctcctctgcaggcccttccctctccgcctgcctcattccctgggcaggcccctttctcaccctctgcctcactcccaatgtctcctttggccacgcctcctccacaggccccacctgttctggcagcgccccttctgcaggtccctccctctccccctgcctcacccaccctgcaggccccacgccgccccccgaccccgggtccggatacctccgtctcgggcccacggctgaccctggcgttggcccccggcccgccgccgccgccctcgcgcagcccgtccagcacgctgagcggcccagacctggccggccacagcagcagcgccacgagcacgccagaggagctgcgtggctacgacagcgggcccgagggcggtgccgcagcctccccgccccccgacgcagagctcgccgcttgccacccggctgcctggagtcgaggccccgctccgccgccggctttccgcggagccccaggtgcgcccctgccgtggcctcccgctaccggaccgggctctgctgacggtctgtgcaccatctacgagactgaagggcccgagtcggcgacccccgcccctggcgcactggatccggggcccagtcccggcacgagcggtgggaaggcggcggctggggccggggccggggcgtcctcgcggagcccgaagcaggcgcgcctgggcgagctgccactgggggcgctgcaggcgagcgtcgtgcagcacctgctgagccggacgctgctgctggcggctgccgagggtgccgcgggcggcagcggcgggggcccaggaggtgcggagggtggtggcgtcacagggggcgcccgggctgcactcagcgacgccgaactcggccgctgggccgaactactgtctcccctggacgagtcccgtgccagcatcacctcggtcaccagcttctctccggacgacgtggcctccccgcagggtgactggaccgtggtggaggtggagaccttccactgagccagaccacagccccgcctgctacaccccacccctgccttaggatccgcccctccgggtacgccgtttgttttagaccccgcctccactgccctggagccccgctgggtggattagtcttagctccctagagcctgagcctttggcctcggaggctcgggacctacccacagctttgacctaggcccgcccctcgagctccgcccctttggcctaggacacgccccgtttccccgagtcccgccccgtgtgcagtgtattgcccaccccgcacagcctgagtttgcaataaaactgggacactgggacttgcaaaaaaaaaaaaaaaaaaaaaa

SEQ ID NO: 629 - DNA, 1352 bp, Homo sapiens
  CDS (222)..(1226)
tttcgtcgatgacctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtaaagtgtgtgggctcagggacagcttgtcccagaggcactgggtaagaactgggggccggccactcactgcccccagatgtggttcattcctgtgtctttggaaacatagttatgcccccagcctgcactggagaacagacaactaagaaatccctcaaaaatgccatctttgatacatggaaaatatagaccttcagtagctaaagtaattaacccactgttatcaaccattaatattgttagtaatatagagcaaaagacaaaaaaaa

SEQ ID NO: 630 - DNA, 2334 bp, Homo sapiens
  CDS (46)..(1179)
aaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcagtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggaatgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactgggtaattctaagaacttttttttttctaaaaaaacaaaagtaacaacgaaataactcccaggactcacagaaaagaaacctggtgccttaacttctctctccctccccactttctccttttccttccttcctggcagtggttaaccttcctctttcttggacagattccactgaagagttaaccacatggctgatcctggtgactgaacttctgggcaaatctggatgctaattgctaactaaatgccctttttaaccagtctctgggttatacagacagaataccagccttttaactcccaaatcttgggggagaatgaaggaaacctggaagtcttgactctgtgctttctgcttagagtggctttgggaagtcttgtgcatactaaatttgggaagaatccccaaaagtgtcatgcttttaaacaagaatttcatggcacccatgtttgttgtttcttagcccaagagaatctaacttgctttgttgttctctttcccctgaagaaaaggagcagcatgtgttttgttctgtaatttgatgttgatcttctcagccacaccactgccctttgaatgtacaccttcatattttaacagctatgtaacttttccagggaaggttatttccattaaaggtattggctgctctgtgtgcaagagtctgttacaaagcttgctgtgcatgatcatggttaagccacaacatcaaaacccaagtccaggagttgctaactgcactcttttttattgtagttctcagcaaaaggaccccggaaacattgcaaactattctaatacctcagtttgaattgccactgagcactctaggtaaaaaataataaatactgcagctttattattaccttggatattgtatgcatgcttcaaagaagtcttttgaattaattacgctaatttatacccaatcccttaaaggtgacacagtcttcaagtttaggatcccaaagaggctctccctatgacaaattgtttggttgggttgtttttcttttaagtggtcatattttaatattatgtttgattcttttaattcagaatcaatatgtcactgaacaaattgatcatttctgtattttttgtaaatgtgtttactctattgtctctcttaacagagaagatatatttatgatatttctgcagactgcttcttataattcttagaattcttctgagtgaagtatg

SEQ ID NO: 631 - DNA, 3136 bp, Homo sapiens
  CDS (260)..(2221)
attttgcaattgtgggttggctgaagaaaagaagacaacatgggaaaggaaaatctgggtgataaacggattaaacctttaggttaccgctgctctagataaacccatgatgtgactttttgtttttctcctaggtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaacgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcagttaggttgtttgtgatccaacaagaacatttccaaaagtatctaggtgttctcaaataaaaagctttctttgcacaaccc

SEQ ID NO: 632 - DNA, 3200 bp, Homo sapiens
  CDS (1)..(2277)
atggatagtagcatccacctgagtagtctgatcagtcggcatgatgacgaagccacgagaacatcgacctcagaaggactggaggaaggtgaagtggagggagagacgctcctgatcgtcgaatccgaggatcaggcatcagtggacttatcgcacgaccagagtggggattccctcaacagtgatgaaggagacgtgtcttggatggaggagcagctgtcctacttctgtgacaagtgccaaaaatggataccagccagtcagctgagggaacagctcagttaccttaagggtgataatttttttaggtttacttgttcggattgctcagcagatggcaaggagcagtatgaaaggctgaagctgacatggcagcaagtcgtcatgttggcaatgtacaacttgtctctggaaggaagtggacgtcaaggttatttcaggtggaaagaagatatctgtgcttttattgagaaacattggacttttttactagggaataggaaaaagacgtctacctggtggagcaccgtggcaggttgcctcagcgtgggaagtcccatgtacttccgttcaggtgctcaggaatttggagagccaggatggtggaaacttgttcataacaagcccccaacgatgaaacctgaaggagagaagttgtctgcctctactttgaaaataaaagcctcaaaaccaactttagatcccatcattactgttgagggacttagaaaacgagcaagtcggaatcctgtggaatctgccatggaattaaaagagaaaaggtctcgaactcaggaagcaaaagacattagaagagcccagaaggaggccgctggctttcttgacaggagcacatcttctacccctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatgatgacgatgagatggaaggcgatggagtcatagacccagggatggagtacgtcccaccccctgctgggtcagtagcttctgggccagtggttgggggcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccagacttccttgccgtccaggaagggatttcgacaccagaccaccaagtttttgtatcgcttggtaggatcagaagatatggctgtggaccagagtattgtcagcccttatacctctcggatcttgaaaccttatatcaggagcgaccctcactggacgccggagcccgacgcacctctcgattactgttatgtgcggccaaatcacatcccaacgatcaactccatgtgtcaggagtttttttggcctggcattgacctgtctgagtgtctgcagtacccagacttcagtgttgttgttctttataaaaaagtcatcattgcctttggcttcatggttcctgatgtgaaatacaatgaagcttacatttcatttctgttcgtccaccctgaatggagaagagcagggattgcaactttcatgatctatcatctgattcagacctgcatgggcaaggacgtaacccttcacgtctcagcaagcaaccccgctatgctactgtaccagaagtttggattcaagactgaagaatatgtattagatttctatgataaatattacccattggagagtacagagtgtaaacacgcattctttctgaggctccggcgctgatgcgaatacagctcacagagaaacgcatgtgctattggagaacaggtctttgtggagatctaaaggcagtgattgatttcacagggagctctaatctctgtgattacatggtccttcaaactcccaaccaaagtgagaaaagcggcatgcagtgaaatgagcagtgagcagccctttagcaaaatcgccctccagtccttcctggagatgccttcagccagcatcccagactccacagttatttatgaacgatgtcgtgattctccctccacctgacagtttgtaagagtgaaagagcatctaacctgatgctcttggagagagataacctgtctgtcataacttaaaggatgagaaaatgtggtgtagctattaaagattcatgcagtcccaaaaggcactgtcctgggatgatgagagattataaggtgatttcataaaaggaatccaaccctgtgcccggccattgatgtgttgtcattgaatccaggaggatttctagggcactgaagttttgttgtttcttttgctgactttggttacagtcagaaaaaataaactagatgtttgtgtctacatgttctacctgttgtacctattagcatcttcctgcagggacttgggcccatggcctgggaggttggtttgggattggggttgttgggcagcctgccattcacctggcctatcctggcccttctcatgcccaagacagttgtttcacaggagtggaagtgtgggtgatgcaagtagaaccctctagatgtaccctgtgtggtctgcaggactggactgtttgctgtgtttgtggatgttggcgatagactgtcaattaggttgtttgtgatccaacaagaacatttccaaaagtatctaggtgttctcaaataaaaagctttctttgcacaaaaaaaaaaaaa

SEQ ID NO: 633 - DNA, 1375 bp, Homo sapiens
  CDS (2)..(1219)
ttttgacccgcgctgcaggaattcggcacgagggaaggaactgctcctctcttctttgaagcccttcagcttcctggagaaggaggagcagctaaaggaagctgctcgacagagagacttggcagccacagctgaagccaagatctccaagcagaaggccaccagaaggattcccaagtccattctggagccagcccttggggataaactccaggaagctgagctcttcaggaaaattcgcatccaaatgagagccctggacatgctccagatggcctcttcccctatcgcctcctctagtaaccgggctaacccacagccccgcacagccacccgaacccagcaggaaaagcttgggtttctgcacactaacttcagattccagcctcgggtgaatcctgtggtccctgactatgagggcctttacaaggccttccagagaagagcagccaaaagaagagaaacccaagaggccactcgcaacaagcccttcttgctgaggaccgccaacctgcgccaccctcagcggccctgtgatgctgccaccaccggaaggaggcaggattccccacagccaccagctacacccctgccaaggagtcgttctctgagcggccttgcttccctctctgccaacactctccctgtgcacatcacagatgccaccaggaagagggaatctgcagtcagaagtgcacttgaaaaaaaaaaaaaagcagatgagagtattcagtggctggagatacacaaaaagaagtctcaagcaatgtccaaatctgtgaccttgcgtgcaaaagccatggatccccataaaagcctggaggaagtgttcaaagcaaagctgaaagagaaccggaacaatgaccgtaaaagagcgaaagaatataagaaagaactggaggaaatgaagcagcgaatacaaacaaggccctatctctttgaacaagttgccaaggatctagccaagaaagaagcagaacagtggtatctagacaccctgaagcaggctgggctggaggaagactttgtgagaaacaagggtcaaggcacccgggctgttcaagagaaagagaccaaaatcaaggattttcccaggttccaagaaactacaaaactcagcatcagagatccagagcagggtttagaaggatctctagaacagcctgcaagccccagatgcgtcttttttggtggtgacagagtaactatcacctgggcttaagaaatgaagatgttcttgttgtttcctaagactcctcggttcagttttactggtatggaatcctaagggtaaatcaatacactattttaaagggaaagattaaattcttaatctctaagaaaacaaattttgtataaaacaagaaaaaaaaaa

SEQ ID NO: 634 - DNA, 2584 bp, Homo sapiens
  CDS (44)..(631)
ttctgagatttgtagtccgtgtgcgggaattcattaaagcaagatggccgcgccctgcagattgtctcttgtatgcgtaagtttttttgaccgtcactcgtgtcagcttcaaagtcagatagatttttctcccagcatgttctacttccgaggctgtggccgttgggtcgcggtttccttcaccaagcagcaatttccgttggcacggttgagcagtgacagcgcggcgccccggactccgcacttcgacgtgatagtcattggtggaggacatgccgggactgaggcagccaccgccgccgctcggtgcggctctcggactctgctcctcactcaccgcgtggacacgatcggtcagatgtcatgtaatccttcctttggtggcatcggaaagggacatttaatgagggaagtagatgccttggatggcctgtgttctcgcatctgtgaccagtctggtgtacattataaagtattaaaccggcgtaagggaccagctgtgtggggtctgagagctcagattgataggaaactctataaacagaacatgcagaaagaaatctttgaatacaccactgcttactgttcaggagggagctgtagaagatcttattcttacagaaccagagcctgaacacactgggaaatgccgtgtcagtggggttgttttggtggatggaagcacagtatatgcagagagtgtgattctgactactgggacatttctgagaggcatgattgtaattggattggagacgcatccagcaggacgtttaggggatcagccttctataggattggctcagacactggagaagttagggtttgtggtgggaaggttgaagactgggactccaccccgaattgccaaagagtccattaatttcagtattctaaacaagcatataccggacaatccatccataccattcagctttaccaatgagacagtatggattaagccagaagatcagctgccatgttacttgactcacaccaaccctagagtggatgagattgtccttaagaaccttcaacttaatagtcatgttaaagaaacgacaagaggacctcgatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggctacggtgttcagtatgattacttagatccccgtcagatcaccccttccttggagactcatttggttcaacgactcttctttgctggacagatcaatggcaccactggttatgaggaagctgcagctcaaggtgtgatagccggaatcaacgccagtcttcgggtcagtcgcaagcctccctttgtggttagccgaacagaaggttacataggagtcttgattgatgacctcactactctgggcaccagtgaaccataccgcatgtttaccagccgagtagagttccgtttgtcactgcgccctgataatgctgacagccggctcacactgcgagggtataaagacgctggctgtgtgtcccaacaacgatatgaaagagcttgttggatgaagtcttctttagaagaaggcatttctgtgttgaaatctattgagtttttgagctctaaatggaaaaaattaatcccagaggcttctataagtactagtagaagtctgcctgtcagagctctcgatgttctgaagtatgaggaagttgacatggattcattagccaaggctgttccagagcccttgaagaagtatactaaatgtagagagctggctgaaagactgaaaatagaagccacttatgaatcagtgttgttccatcaactacaagaaataaagggagttcagcaagatgaagctctccaactgccaaaagacctagattatttgactatcagggatgtgtctttgtcccatgaagttcgagagaaactacattttagtcgtccacagacgatcggggctgctagtcgcatacccggagtaacacctgccgccatcatcaatctgctgagatttgtgaagaccactcaacgaagacagtcggctatgaatgaatcatccaagactgatcaatacttatgtgatgcagacagacttcaagagagagagttatagctttcaattcataaaagatttttaaagagcatataaataatttgatcaatacaacagtatagataaaagaattatttagcacatgttaaaatagctttattaggttactatgggtttgccattaatttctgagtgggacagaaattataattgtgctttttcgtgtatatgaaaaaactagtcgtaaacaatttgtactctttctttaaggagctgtaatacaaataactttgtgcagtgttcatcaaagagagagacagtgaacctaaaactgaacctggaataaaactcaacatgcagatttgcctactcatagggactttgcctattaagtctaccaaattaaaagtcttatcattcaaaaaaaa

SEQ ID NO: 635 - DNA, 392 bp, Homo sapiens
  CDS (110)..(298)
tgtcgttgttctgagcctgccttgcgcagccaggcgtcgaggaggcggcggcgagtgctgcggtgctggctgggtggccgagtggtccccgcagcctctggacccagccatgctgctctggatgcagggcttcgtgctggaggcggtggcctgccaggataacgatgactacttacgctacgggatcctcttcgaagacctggattgcaatggggacggcgtggtggacatcattgagctccaggaggggctgagaaactggagctccgcgtttgaccccaactccgaggagcatggatagtgatggatcaatgacagtagactgggatgaatggaagtactactttttactgcatcctgcaacaaatatcactgaaatgattcatttctgg

SEQ ID NO: 636 - DNA, 843 bp, Homo sapiens
  CDS (252)..(689)
gggtacaattccttctcatagcagcagaggtgtctaatttgcaaatactctttaatgtgaagactaccttcagagtaagtttacaggcaccccctcttcagagagctgagtcaaagttgctgttgggcaccttctggtgtttagagaaaccagcaccagcgcgcccatttcgagcccaagtttccagctcgggtttccgggctcagaattttccaggagtgggttcttgggcagtggctgtgggagcaggaatggcgcagctagagggttactgtttctcggccgccttgagctgtacctttttagtgtcctgcctcctcttctccgccttcagccgggcgctgcgagagccctacatggacgagatcttccacctgcctcaggcgcagcgctactgtgagggccatttctccctttcccagtgggatcccatgattactacattacctggcttgtacctggtgtcagttggagtggtcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagccttgtcaacattaacactagccagtatttccaacactctatttttttaacttactttattatacagaagcaggatctatgttttttactctctttgcgtattcgatgtgtctttatggaatcataaaaccttcaccttcctcgcatttggtgcttcatgttccggaaacaaaatcatctgggttgtcttctgtgcggaca

SEQ ID NO: 637 - DNA, 1589 bp, Homo sapiens
  CDS (303)..(1400)
aactgagacatagatgagggcataggcagagcgaggaagcagcataccttgtgaggaatatatgacatgaactcaatgacagtgacagggaatgtgctctactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccagtacaaagagaccagcactttaatcaacaccatacttgaggttcagccaaggtcatctactggtggagagggaaaaagcaatgacgaaattgttcaagaacttgttgcttctgtccagaccagagttccagaaaaactggaaatggagggtgcttctgagagcctttttgtcaaggatcttcaaggacgtctgaactccttgaccaccgttcttggacaggaagtggaccggtttaacaacctgctgaagttaattcatacttctctggaaacactcaacaaagccatcgctggatttgtggtgatgtctgaagaaatggaaaaagtgtataacagtttcctcaacaaccaggttcccgctctgtggtccaacacagcctacccatccctgaagccactaggatcatgggtcaaagaccttatcctgaggacctcatttgtggatctgtggctcaaaagaggacagcctaagtcctactggatctctggtttcttctttcctcaaggatttctaacaggaactcttcaaaatcatgctcgaaaatacaatttgcctatagatgagctgagtttcaaatacagcgtaattcccacctatcgggatcaagctgcagtgatagaagctgccaagacagtgcaatttggacaagaactgcccatggacatggagttgccctctcctgaggatggtgttcttgttcatgggatgttcatggatgcttctcgatgggatgataaggagatggtgatagaagatgcattgcccggacagatgaatccagtgctgcctgtggtgcattttgaaccacaacaaaactataagccaagcccaacactttaccactgcccactttataaaacaggagcccgggcaggaacactctcaaccacaggacattcaaccaattttgtggtaaccgtcctgttaccctccaagcggtccaaagactactggattgccaagggatcagctttgctctgccagctgagcgaatgaaaaggtgccccctcagccctgaaaaagaaccaggccagagatctttcctaatgggagcaaaaggtttgaataatttatatgtgagcaaaacggtgttaattctgatttgacttaaacgtattgtgacttttatttctcttatgaccttaaaataaagtgtttgagttctttcaaaaaaaaaaaaaa

SEQ ID NO: 638 - DNA, 2444 bp, Homo sapiens
  CDS (86)..(577)
gctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagtttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaaaaaaaa

SEQ ID NO: 639 - DNA, 657 bp, Homo sapiens
  CDS (187)..(591)
  misc_feature (1)...(657): n = a,t,c or g
ggagagnngtngnnattgattatgatcggcctgangaattcggcacgaggttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctgattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaaaaaaaaaaaaaaaaaaa

SEQ ID NO: 640 - DNA, 1619 bp, Homo sapiens
  CDS (241)..(915)
tctcgcgcccctgtcggcgcggaaccctggctcgtccgcggccagctccctggagcctcgcgtagcgggggcgcccccgcgagctgcgctctccccggcggagcgctcctcctccagcccccagcccgcagggtactttgccctcggagcgaaggaggctccagaactggtagagccgggccatcgggctgggcactccccgcgggcccgacccgggcctgggcgcccagccggacaggtatggcgttgacggtggatgtggccgggccagcgccctggggcttccgtatcacagggggcagggatttccacacgcccatcatggtgactaaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtctcaggctacgtctccagggcagaccaatggggacagctccttggaagtgctggcgactcgcttccagggctccgtgaggacatacactgagagtcagtcctccttaaggtcctcctactccagcccaacctccctcagcccgagggccggcagccccttctcaccaccaccctctagcagctccctcactggagaggcagccatcagccgcagcttccagagtctggcatgttccccgggcctccccgctgctgaccgcctgtcctactcaggccgccctggaagccgacagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtggcacgccagccttcttgcccagctcactgagcccccagtcctccctgcccgcctccagggccctggccacccctcccaagctccacacttgtgagaagtgcagtaccagcatcgcgaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaaaaaaaaaaaaaaa

SEQ ID NO: 641 - DNA, 760 bp, Homo sapiens
  CDS (196)..(528)
tgtgacggctcgctgttgccctgaaggcaggcgagccagctgcccaggaaaggtggaaagtggtagaagctgacccctgagccctggcaggtctttaagtgcgtttgtgcagccgatttcaaggctaagagagaaagactgcctctgatccctgaaggaagaaaaaaaaaaaaaaaaccgggaaaaaaactcaccatggaaaatgtccccaaggaaaacaaagttgtggagaaggccccagtgcagaatgaagcccccgctttaggaggtggtgaataccaggagcctggaggaaatgttaaaggggtttgggctccacctgccccgggttttggagaggatgtgcccaataggcttgtcgataacattgatatgatagatggagatggagatgatatggaacggttcatggaggagatgagagagctaaggaggaaaattagggaacttcagttgaggtacagtctgcgcattcttataggggaccctcctcaccatgatcatcatgatgagttttgccttatgccttgaatcttgaggttaataatcataaaatccctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagatgtttattgcatactgtaaagttaataaagcaatttaaaagcaaaaaaaaaaaa

SEQ ID NO: 642 - DNA, 1114 bp, Homo sapiens
  CDS (101)..(661)
acagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacattttcattgtcagttctcacaaatgactgaaattgttttcatggtaacaagttaaatatactaaagggttcctttttttttactgtttacatttatctctatgttcacctttttagtcacattgacctgctggctgaatacctcaac

SEQ ID NO: 643 - DNA, 2430 bp, Homo sapiens
  CDS (72)..(899)
tttcgtgtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaa

SEQ ID NO: 644 - DNA, 1509 bp, Homo sapiens
  CDS (68)..(1276)
ggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcagtcaggaccggcctctccgattcttacccgccttgctgtctgtctcttggatgttggcgtggcgtgggccacgcatggatccgtggccggaacacgcacacccagccaggctacagctccagagtatggatagctgccttctctccagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaaaaaaaaaaa

SEQ ID NO: 645 - DNA, 1167 bp, Homo sapiens
  CDS (140)..(1102)
gcacgaggcgaggagccgccgccaccaccagcgcacgagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtggcatgggcaacttcaaatcgatatcaacttcaactaaaatggttaatggcagaaaaatcactacaaagagaattgtcgagaacggtcaagaaagagtagaagttgaagaagatggccagttaaagtccttaacaataaatggtgtggccgacgacgatgccctcgctgaggagcgcatgcggagaggccagaacgccctgccagcccagcctgccggcctccgcccgccgaagccgccccggcctgcctcgctgctgagacacgcgcctcactgtctctctgaggaggagggcgagcaggaccgacctcgggcaccgggcctgggacccctcgcgttcgcacaggattgcaagaaggtggcagcaggaaaacaaaccaaaaaagagtcaagacacaagtcgacaaggcattcttaaccgattgaggacggggcccaaagtgggtcaccggtcgatggtggccacccatgacagcccag

SEQ ID NO: 646 - DNA, 1831 bp, Homo sapiens
  CDS (1)..(1764)
atgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaaaaaaaaa

SEQ ID NO: 647 - DNA, 1590 bp, Homo sapiens
  CDS (67)..(615)
ggtcttcgctgttgcccttaaggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtggcgagtagcgaggtgtactgggcacatctctgctacccttctaatcaaattctgctatgaaccttaacactgctctatcacctaacgtccattcaacccccaaacgttcaaaaccacaacccccatcccacaacaacatatacacacaaaatacacacataccacaaccacccacacacacaaaccacccaaaccaacacacgcacaccacacaccatctcactatctacttaatagctgctaaccaacaaagctcaagagtatctgatacacactacaaacataaaacgtagatacatccggaccttatctttacagatctataaactaggaaacaaagctacacactaacaaacaaaataagccaatcataaacaatacataaaactacattcgagaaaacaaaacatacaaataataatcactatccaattctcactacaaaataatacaaaaaaaaaaa

SEQ ID NO: 648 - DNA, 3119 bp, Homo sapiens
  CDS (43)..(2343)
tcagacgctgaactatgtggggatgagctgggtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaa

SEQ ID NO: 649 - DNA, 1169 bp, Homo sapiens
  CDS (137)..(295)
gtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatcattgtatattgattagttaaagggataattaatttaatgctgaggagagtttgacagattttgaaaatgagtaaaggcaaaaaaatttttttagcctttattttgcctttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaaaagaaattaaatcagacaccacatggtggtgtccttggatctcactgtgcagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaa

SEQ ID NO: 650 - DNA, 1395 bp, Homo sapiens
  CDS (49)..(1212)
ggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatcggagcgcctttacccttc

SEQ ID NO: 651 - DNA, 1086 bp, Homo sapiens
  CDS (236)..(880)
cccacgcgtccgattcacgtgatctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggagagtcagagatggagggaggatcagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaaaaaaaaaa

SEQ ID NO: 652 - DNA, 3070 bp, Homo sapiens
  CDS (108)..(2615)
ttcgtagaccttttgaagatccttagtcagtgcggtggaattcgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaaaaaaaaaaagaagacaaacaagggccccgctgtgggtatctacaatggcaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttaaaaaaaaaaa

SEQ ID NO: 653 - DNA, 1568 bp, Homo sapiens
  CDS (137)..(1372)
ttagcgctctaggtacgaggccccggctgtttacggacggcgcccgcctcgattttcccaggcgagggcacgcccgcgtcagtcgcctccggggcaccttcctcgccacgacacgcagaattaattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatgggaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaggcaggactaccaggaaatattagactctcccattaaatgaatacctgattattattgtctcattaatgttcagttattaatatgtatactgccattttaatgtttacctatgaatgtcttttgtgttatataactgacagagtgctataaaatatataatatatacaaatgcagaaaatttattctagtctaatatattcaaatacaaatattaaatatatgaaaaaaaaaaa

SEQ ID NO: 654 - DNA, 3446 bp, Homo sapiens
  CDS (156)..(2747)
tttcgtcgtcagccggaccccacctggacggctggggccacttgtggtcgccgggaggtgtcacctctaactcttcgtgtcaggagtttttctacctctccggagttctttggctctcaggaacctagcacggcatcacgcgagtcccggctcagatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacacagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactatatggg

SEQ ID NO: 655 - DNA, 3335 bp, Homo sapiens
  CDS (156)..(2636)
tttcgtcgtcagccggaccccacctggacggctggggccacttgtggtcgccgggaggtgtcacctctaactcttcgtgtcaggagtttttctacctctccggagttctttggctctcaggaacctagcacggcatcacgcgagtcccggctcagatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacacagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactatatggg

SEQ ID NO: 656 - DNA, 551 bp, Homo sapiens
  CDS (183)..(548)
tttcgtctgggaggagcagccggctggctgccctgcagaggtcaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcaggtgcgtggggcgcgggcgggtcctcgcctccccggaaggtgttgtggggcgacagtgcggggacgccgggcgggggtggacgttctgggcccagccctgtcctcagaggctgctggggcagaagcccggggctgggggatgccggggatggatgttggggtgggtgcctccgagaccagaggagccctgttccttggcagggaaggtgtgcacgggccttgcccgatggatggtttagggccatggccctggggtccctggtgagcagtggggccgcctctgcccttggcctgtga

SEQ ID NO: 657 - DNA, 1786 bp, Homo sapiens
  CDS (114)..(1514)
tttcgtgttggagcagcggaggcggcgcagaggcgcgtcttgggtccccgcggcggcgccggtgccaagcgctggtttgcggatacccaggcagatctgcagtgcctaatgccatgagtgtggtggttcagcatgtggaggaaaaagctgtgcactcctggtcgcgcatctccacggcagggaagaaggccctggaagaggcactgcttgtctttaacccaatgagccaggatctcagtgccacagaggcccagcttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcactggtcaaggctaaggccaaagctaaggcagcacaggtcaaggccaaggccaaagtcatggcagcacgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactccaggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttcc

SEQ ID NO: 658 - DNA, 2192 bp, Homo sapiens
  CDS (3)..(1172)
tgatgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaaaaaaaaaaaa

SEQ ID NO: 659 - DNA, 2054 bp, Homo sapiens
  CDS (3)..(1034)
tgatgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaaaaaaaaaaaa

SEQ ID NO: 660 - DNA, 615 bp, Homo sapiens
  CDS (127)..(561)
tttcctcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggtacacaaaaactgcattaatacacttaacaagggaagttgtatttttaaaaaggcgtttttgtttttctttagttttggatttctttactgatttctaatactaataaagccttggggtttcttgataagtaaaaaaaaaaaa

SEQ ID NO: 661 - DNA, 1751 bp, Homo sapiens
  CDS (186)..(1346)
gtagccttgcctatgagcctgcagtttttaatttgtctgagtcctggacctcagcctagatgtaaccttgctctgttgctgtcctctataggcctggcactgtggactcggtgttgtctagcagagaggccttgaggaagtggcccagcagtgtgcttgcgtttccaaggattgagctcaaggagatggaaaacaaactgcctatggagacccttgtagaagaatgtggagagaatagagaaaggaagtgcaagttaaaagaccagtcagacaaagaagaaggcaccagagatatctcatcacccaaaagacttcgagatagacaagctttgttccctgccaaagtgacaaatgtcagcttgctggaaaagtttgaacgaagtgagagtggtgggaagattatgacccctgaaagcttatcatatccaagttgtctgaaacacgacagtgagatgaagccccaaacatctccagcttgccaggatcataacaaggcaggacagatgaaaagtctggctactagagaacagaatcagaaaaatgctgcctataatcttggagttgctgaagctataagaaaccacaagaatgagaaaccggaattttatatttccttcctatttgacaaacggccactcagtcctgcgcttaatgctcttaagcaagaggaatattcccggagtctcctgaaacaaatggataacagacaggaaaacgaaataaagcaaagacaatacagagagttgatggaccgcctggaacaagtgcaactcacagaggaacttgctgcgcaaagagcgaaatttttaaaagataagatggaagaaacacagtgttacaagagagctttggatgcacagataaagaacaaaccctctcggctgcccccctttgagccagactcctctgagcccatctttggtaagaatgagggtgaactgatggtggaaaagcaaaagcgagaacaaaattacatgaaacaccagctggaggcagctgctaaccacaagaggaaagccatcctgcatcaactagtggaccagaggcgggatttgcaaatgcttcagaggacacaaagagagcacttggcagacagaaccgctgagctggagcgagtaaatagagtcaaccaatgcttacaggaggactgggaaaggagtgctgcgatgaagaagcagcgagacctggaggacaaggcttttgaacgggcttcagacaagctgtttctcctagaccagtgtgagaagtatcggcgctgcaagcaatgccagaggcgcacctccaacgtgggcgagagcaacctgtggcccctgaacaagttcctgcctggctcccggttgcttgtgtaaaactcaaagtttggctcttcgtttcccggggaaagtttttatcttttacatgtttgggggtgattgtgaaactgcgtatttttacctcagagaaaaaaatcattgtttaggtttggtgctttcattagattgcttgttaagcccttattgaattcactcctgctttcctcccacccccaattatttcctatactagtttctgatggcagtgaaggtgtctgaatggtcctgagggctagaacctgctgcacaggggctgggaatgggatccagcttcattatggctgctggggtgctgctgacccagccctgctgctgctccatgactttgtgtacaaaacttttttcatctgtaatgaatagtggcaataataaatattttttaagcgcctgaaaaaaaaa

SEQ ID NO: 662 - DNA, 900 bp, Homo sapiens
  CDS (580)..(807)
ggcggcggcggcggcggcggcaagtgcacggggtacgcccgtcccgctccgcaggggcagagggggaggggatgaagctgcccggcgccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaaaaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgaaaaaaaaaaa

SEQ ID NO: 663 - DNA, 2130 bp, Homo sapiens
  CDS (40)..(1875)
gttgcagatactcttcaaaaagtttgggctgtattggaaatgaatttagaacagtatgcagtttctctcttaagactaatgtttaaaagcaagtgcaagtctttggaatcttatccatgctatcaagatgaagaaactaagattgcttttgcagattatactgtgacttatcaagaacagccaccaaattcttggtttatagtattcagagaaacatttttggttcatcaagacatgattttggttcccaaagtatatactacacttccaatctgtatcctacacattgttaataatgacacaatggagcaagtgccaaaggtgttccaaaaagtggtgccttatctttataccaagaataagaagggatacacttttgtggcggaagcgtttacaggcgacacatatgtagcagcctcacgatggaaactgcgtctcatcggttcttctgctccactgccatgcctctctcgagactctccatgcaattcctttgccataaaggaaatccgagattactacatacccaatgataagaaaattttattcaggtattcggttaaagttctaacaccacaacctgctacaatacaggtacgcacatccaaaccagatgcattcatcaagctgcaggtcctagaaaatgaagaaactatggtgagctccactggaaaaggccaagctataatcccagcatttcacttcttgaagagtgagaaaggtttgagctcccagtcttatggtgaaagacacgaggagttaattaacttaggaagcccagactcccacactattagtgagggacaaaaatcttcagtaacttccaaaacaacaaggaaaggcaaagaaaagtcttctgagaaagaaaagacagccaaagaaaaacaagcacctcgctttgagcctcagatatccactgttcaccctcaacaagaagacccaaataaaccctactggattttgaggttggtcactgaacacaatgaatcagaattatttgaagtgaaaaaggatacagaaagggcagatgaaatccgagccatgaaacaagcctgggagacaactgagccaggaagagcaatcaaggcttctcaggctcgtttgcattaccttagcgggttcattaagaaaacatctgatgctgagagtccgcctatatctgaaagccaaactaaaccaaaagaagaagtagaaacagctgcacgtggcgtaaaagaaccaaactcaaagaattctgcaggttcagagagcaaagagatgacacaaacaggatcagggagtgcggtgtggaagaagtggcaattgaccaaaggcttgagggatgtggcaaaatccacgagtagcgaaagtggaggagtgtcttcaccagggaaagaagagcgcgagcagagcacacggaaggaaaacattcaaacaggacctcgtacacgatctccaacaattttggaaacatctccacgacttattcgaaaagcactagaatttatggatttaagtcaatatgttcggaaaacagatacagatcctctgctgcaaacagatgaattgaatcagcagcaggcaatgcaaaaggcggaagaaattcatcagtttcgacagcataggaccagagtccttagcattcgaaacattgaccaagaagagcggttgaagttaaaggatgaagtcctggatatgtataaggaaatgcaggactccttagatgaagcccgacagaaaattttcgacatccgggatgagtacagaaacaaattgctggaagctgagcgcctaaagctggaaactctggctgctcaggaagcagccatgaagctggagacagaaaagatgaccccagctcctgacacacagaaaaaaaagaaaggaaagaaaaagtaaccaggggatgtccaatactaccctgcttctggagagaaaaaatctatttgtaatgatctttaactgcctgctgttaagatattaggccaactgaaaatagaaatttctctttcttagaaatattttaatgctaacttgttagttttcctcagaaagctagtatttgaagccattcgagtttaagatgctctaatttcaataaaatagcttccaaatatttaataaaatatgtttgacactctaaaaaaaaaa

SEQ ID NO: 664 - DNA, 3662 bp, Homo sapiens
  CDS (251)..(2362)
gccgactgcatttcctcagtcacgggcctagaactccaaggagaaaggcggcggtgcgtgttgctgcgagtgggacgcgcactggtcggtgccggctcaggagccggggaattcatgatttgttcctgtagctgaaacatacattgaatgctttctgccctggcatgaacttacatggtcagagctggtttttcctgccctcaaatatatttctctgactctaccggttagactagaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccccccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaacttcatataagacagatggatgatctgtgaacataagtgtttattaaaaatggcaattaaatataaattacttttgtgggggaatgcctaataaatacattgactatatataaaatgaatatatacatacacatgtatgcctgtatatatatattcattctccagtgttgctgaattaaaattctgctggactttttaacatagcaaatccgatgtttataaactggtaatcaaaaaggttttttcttttaggtgagtgggaaagtattacccttgttttaaatatctaagcaatgcctatcaacccttttttgtgttatgattactgtagtcatatttatgaaaaaaggtttgtgttttactcttgctagtgagaaaagtgggacaaaatatacttttgaaataaaatgctatatggcacctaattattttttcttttaaaatgccttaagttgcagtctaatttttaaacactggaagcaaatgattatcaaaatgagactgcaacttaaggcattttaataatcattgcttccagtgtttaaaaattaaaaaaagaatggggagaaggttatgagaagagcattattaagtttccaaatttaatttgaattccaaattcacctagcaataaaatctaatttttaaaaagtatataaatataaaatgtataaatgatggatagatttttgtattgatttgcaaaatgcagattatatttgataggctatagtatgtagatattccttttaggaatattacagctgtaaattatatgagacttgccagtcaaatgctatttggtttaaaaaaattattgcaatctcaagttaatggaatatttttaaatcccacattcagagtttaaaacactggttttcaatgtgttttttagtgttgtcacttgtttatagataaatatataaataacctgtttggatcctggtcctttttaactgttccttggtaattctgagcatttatttgatgacttaatatttttcactacctttggagaacagatgaacattattcaccatgaatggatctatactgtgtggtcatgagttgtgtatacttccataacactgtatttttcttctgtcagtacccttaggatacactttaaaacaccttaaggtctgatgttatggcaacaaactactttttcaaacctaaataggaaccatgtaatttctcaaaagtgattgaacagtttgcccacacttagtttgttggtcttatgtaaaacattggctcaaaataaagtacacactgatttattttaaaaaaaaaa

SEQ ID NO: 665 - DNA, 1232 bp, Homo sapiens
  CDS (80)..(1018)
gatactcctccggaatttccgggtcgacgattccgtcctatctcaagagagagatattttactcatttcctggttgtgaatgatgggctcttggaagcactgtctttttagcgcgtctcttacctctgccctgatttttgtatttgtttacaatactgagttatgggagaataaacgttttctgagggcagctctgtccaatgcttcactgttagcagaagcctgtcatcagatttttgaggggaaagttttttacccaacagaaaatgcattgaaaactacccttgatgaagctacctgctatgagtacatggttcgaagccactatgtaacagaaacactctctgaagaagaggctgggttccctttagcttacacagtgaccatccacaaagacttcggcacttttgagaggctcttcagggcgatttatatgccccaaaatgtctactgtgtgcacctggatcagaaggcgacggatgcctttaaaggtgcagtgaaacagttactcagctgcttcccaaatgcttttctggcttccaagaaggagtcggttgtctatggggggatctccaggctccaggctgacctgaactgcctggaagaccttgtggcctctgaagttccctggaagtatgtcatcaacacctgcgggcaagactttcccctgaaaaccaacagggaaatagttcagtatctgaagggatttaaagggaaaaatatcacccccggagtgctgcctcctgaccacgctgttggacggactaaatacgtccaccaagaactgttaaaccacaaaaattcctacgtgattaaaacaacaaaattaaaaactcctcctcctcatgacatggtgatttactttggcacggcctacgtggctctcacaagggactttgctaacttcgtcctccaagaccagctcgcacttgacttactctcctggtccaaggacacctacagccccgacgaacatttctgggtgacactcaacaggattcccggtatgtacgtctcttaacttttatttttacgaataaacactgcatggtcaatactaaataagttgctttgaaaagagtggaaaaaatgggacaaacttctttacggttttaaatgtcaaattaaaaaaaaaatttcatctgtaaaatggtaaaatggagatgtgttatatcacccactcttgtgaaccgctctgttcacaggacaaaagaccgaaggaacactggcca

SEQ ID NO: 666 - DNA, 3396 bp, Homo sapiens
  CDS (92)..(2773)
cgccttgtgtgtgctggatcctgcgcgggtagatccccgagtaattttttctgcaggatgaattaagagaagagacacttgctcatcaggcatggagagcactttgtcagcttccaatatgcaagacccttcatcttcacccttggaaaagtgtctcggctcagctaatggaaatggagaccttgattctgaagaaggctcaagcttggaggaaactggctttaactggggagaatatttggaagagacaggagcaagtgctgctccccacacatcattcaaacacgttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttgcaccccgtggggtggtgcacacagaacaacaaggtgttgatgccgccggacgcaatcaaagagaagtacacagactggacagaatttctcatacgtgacttgactggttcgaggacagcacccgccaacctcctggaaggtcctctgcgagggaaaggccctatagacctcattacagttggttccttaatagaacttcaggattcccagaacccttttcagtactggatagttagtgtgattgaaaatgttggaggaagattacgccttcgctatgtgggattggaggacactgaatcctatgaccagtggttgttttacttggattacagacttcgaccagttggttggtgtcaagagaataaatacagaatggacccaccttcagaaatctatcctttgaagatggcctctgaatggaaatgtactctggaaaaatcccttattgatgctgccaaatttcctcttccaatggaagtgtttaaggatcacgcagatttgcgaagccatttcttcacagttgggatgaagcttgagacagtgaatatgtgcgagcccttttacatctctcctgcgtcggtgactaaggtttttaacaatcacttttttcaagtgactattgacgacctaagacctgaaccaagtaaactgtcaatgctgtgccatgcagattctttggggattttgccagtacagtggtgccttaaaaatggagtcagcctcactcctcccaaaggttactctggccaggacttcgactgggcagattatcacaagcagcatggggcgcaggaagcccctcccttctgcttccgaaatacatcattcagtcgaggtttcacaaagaacatgaaacttgaagctgtgaaccccaggaatccaggagaactgtgtgtggcctccgttgtgagtgtgaaggggcggctaatgtggcttcacctggaagggctgcagactcctgttccagaggtcattgttgatgtggaatccatggacatcttcccagtgggctggtgtgaagccaattcttatcctttgactgcaccacacaaaacagtctcacaaaagaagagaaagattgcagtcgtgcaaccagagaaacaattgccgcccacagtgcctgttaagaaaatacctcatgacctttgtttattccctcacctggacaccacaggaaccgtcaacgggaaatactgctgtcctcagctcttcatcaaccacaggtgtttctcaggcccttacctgaacaaaggaaggattgcagagctacctcagtcggtgggaccgggcaaatgcgtgctggttcttaaagaggttcttagcatgataatcaacgcagcctacaagcctggaagggtattaagagaattacagctggtagaagatccccactggaatttccaggaagagacgctgaaggccaaatacagaggcaaaacatacagggctgtggtcaaaatcgtacggacatctgaccaagtcgcaaatttctgccgccgagtctgtgccaagctagagtgctgtccaaatttgtttagtcctgtgctgatatctgaaaactgcccagagaactgctccattcataccaaaaccaaatacacctattactatggaaagagaaagaagatctccaagccccccatcggggaaagcaaccccgacagcggacaccccaaacccgccaggcggaggaagcgacggaaatccattttcgtgcagaagaaacggaggtcttctgccgtggacttcaccgcgggctcgggggaggaaagtgaagaggaggacgctgacgccatggacgatgacaccgccagtgaggagaccggctccgagctccgggatgaccagacggacacctcgtcggcggaggtgccctcggcccggccccggagggccgtcaccctgcggagcggctcagagcccgtgcgccggccacccccagagaggacacgaaggggccgcggggcgccggctgcctcctcagcagaggaaggggagaagtgcccgccgaccaagcccgaggggacagaggacacgaaacaggaggaggaggagagactggttctggagagcaacccgttggagtggacggtcaccgacgtggtgaggttcattaagctgacagactgtgcccccttggccaagatatttcaggagcaggatattgacggccaagcactcctgcttctgacccttccgacggtgcaggagtgcatggagctgaagctggggcctgccatcaagttatgccaccagatcgagagagtcaaagtggctttctacgcccagtacgccaactgagtctgccctcgggaggtggcccattattgctgggatgcggtgttggtaaaggtttccaggactgaaactttgattttccgggatatgttaaatggtacagccactaagtatcaccagaaaaccagaagcccaggatcttctgcctccgccagcctgtgagctgtttccatgttttcaaagcacagcagcagtcgcttctggggagtgccagttaaagtcatgcatcagaccctgccagacgtgggcctgcttcttggctcacccacgttttgcctttctcctgccccaaatcaggcagctcccttggagcagggtttcctcagatgaggactgcattctttgaaaacaaagaatgtcgccaaggaagaaacctcacgccatgctgtagtgtttcctgtaatcacacgagcacatttatatatgcagtttcccatggataggcgtgtgaccctggttgagtggcacctgcggtttcatcttggtggcaactcctttgcaatgcagctggcagcgacatccttataaaaacatgtgctaaagctctgtcctctgttagaggtgccttttaggaatacggggagtgaaggaaggccggcaggcatctccatgcaactagatgg

SEQ ID NO: 667 - DNA, 1648 bp, Homo sapiens
  CDS (278)..(1099)
gcttcggtgaggccgccgtgggccccatcttccggcggtcgccggagtttgtggtgattgttgctgccgccgccaccgccccggctgccatctcctcctcctgggccgccgcctcctcctcttcctcctcctcctgggccgggctgaacccctccccgctgccgcctcctcctgggctgggcccgcggtgtctcgtcccctcgcggagccgctcctgccgccgccgccgccgcctcctcattcatcctcgtgcaccataggcggcacaggcaccaagatgtccaaccgagtggtctgccgagaagccagtcacgccgggagctggtacacagcctcaggaccgcagctgaatgcacagctagaaggttggctttcacaagtacagtctacaaaaagacctgctagagccattattgccccccggagaattttcatccttgggccttctcatcatgtgcccctctctcgatgtgcactttccagtgtggatatatataggacacctctgtatgaccttcgtattgaccaaaagatttacggagaactgtggaagacaggaatgtttgaacgcatgtctctgcagacagatgaagatgaacacagtattgaaatgcatttgccttatacagctaaagccatggaaagccataaggatgagtttaccattattcctgtactggttggagctctgagtgagtcaaaagaacaggaattcggaaaactcttcagtaaatatctagcggatcctagtaatctctttgtggtttcttctgatttctgccattggggtcaaaggttccgttacagttactatgatgaatcccagggggagatttatagatccattgaacatctagataaaatgggtatgagtattatagaacaattagaccctgtatcttttagcaattacttgaagaaataccataatactatatgtggaagacatcccattggggtgttattaaatgctatcacagagctccagaagaatggaatgaatatgagtttttcgtttttgaattatgcccagtcgagccagtgtagaaactggcaagacagttcagtgagttatgcagctggagcactcacggtccactgaagctctgaatcctcagggatgccacctgcacattctcatactctgtccggggtcccagcctagcctttaccacgatactggtcctggtttggggggattctgaaacctcaaactaatagaactttcttctctttttttctagtaggtgtagtccttccttaatttcaactcattaaaaaatgctttatagtttagggcagtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaaaaaaaaaa

SEQ ID NO: 668 - DNA, 3819 bp, Homo sapiens
  CDS (652)..(3336)
gggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgcgaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaggatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcgtcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaa

SEQ ID NO: 669 - DNA, 1798 bp, Homo sapiens
  CDS (429)..(1556)
ttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctgccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtagaaagcttcctacaactggagaagtgcatatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaattggtgggaggtcttcgtattggcttaggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaaaaaaaaaaaa

SEQ ID NO: 670 - DNA, 3721 bp, Homo sapiens
  CDS (45)..(2246)
atggctgccggggaagttggggcgaggcgggccggggatgcgccatggccatggcccggctgggctcgtggctcggggaggcgcagtggctcgcgctggtgtcgctcttcgtcgcggccctggccacggtaggcctgtacctggcgcagtgggcgctggccagggcgcgaccccagccccagcggcgggcggtggagcctggagaggggccgcgcccggggtccgacgcgctgctctcctggatcctgacgctgggcagctggaggagccagtggcaggcggcctgggtgaccgccctgaacgaggaggccgagaggaaagggggcccacctttcctgtcctttgaggaggacccgcggcagcaggcactggagctggtggtgcaggaggtctccagcgtgctcaggtcggcggaggagaaggtggtggtctgtcacgtggtgggccaggctattcagttcttggtcagcgagacgcctgccttgggtgctggatgccggctgtacgacatgcggctctcccctttccatttacagctggagttccacatgaaggagaagagagaggacctccagattagctggtctttcatcagtgtgccggaaatggccgttaatatccagcccaaagcactgggggaggaccaggtggctgagacaagtgcgatgtctgacgttctcaaggacatcttgaagcatttggctggttctgcctctccatcagtggttctgattaccaagcccacgactgtaaaggaagctcagaacttacagtgtgctgcatctactgctcaggaatcctgtcctcctaaacctccaagggctcacgagctgaagctactggtgaggaacatccacgtcttgctgctcagcgagcccggtgcctcaggccacattaatgcagtgtgcgtcgtgcagctgaacgatcctgttcagaggttctccagcaccctgacgaaaaacactccggacctcatgtgggaagaggaattcaccttcgagttgaatgccaagtcgaaggagttacacctgcagatttcagaggctgggcgatcctcagaaggtctgctggcgacggcgacagttcctctggacttatttaagaagcagccttctgggccacagagcttcacgctgaccagcgggtctgcctgcggcagctcggtgctgggctcggtcacggcagagttctcttacatggaacctggtgaattgaaatcctggcccatccctccccctgttcctgctgcaaaaatagaaaaggaccgcacggtgatgccctgtgggactgtggtcactactgtcactgctgtgaagaccaagcctcgcgtcgacgtggggagggcatccccgctgagctctgattctccggtgaagactcccatcaaggtgaaggtgatcgagaaggacatctctgtccaggccatcgcctgccgcagcgcccccgtcagcaaaacactctcttcttcagacacagaattgttggtgttgaatggttcggatccagtggctgaagtggccattcgacagctcagtgaatcttcaaagctgaaactcaagtcgccacggaagaaaagcactattatcatatcagggatctccaagacctcactatctcaggaccacgacgctgccctgatgcagggctacacggcctctgtggacagcacccaccaggaggacgccccatcccatccggagagggcggcagcctctgccccgccagaggaagccgagtcagcccaggcatcccttgcccccaagccccaggaggacgagctagactcctgggacttggagaaggagccacaggccgcggcatggagcagccaggtcctgctggaccccgacggtgatgagctgtcagagagctccatgagtgtcttggagccgggcactgccaaaaagcataaagatgaggagcatggccgctgcctgcgcccacctgactccaccattcgggggacaaaaggacatcttggtgcagaagacaggactgggggcaaggcaggccaagccgtgagctcaggaggaattctaaggaaaggtgcaaagctgttcttccgccggcggcatcaacagaaagacccaggcatgagtcagtcacacaatgaccttgtgttcctggagcagccagagggttcccggaggaaaggcatcaccctcaccaggatcctgaacaagaagctgctctccaggcacagaaacaagaacaccatgaacggtgcccccgtggagccctgcacgtagggcctgaggtcatcacctccaagccagaagacgtgcacccatgttaactaccctcaccaggacgcagccagtgtgtccgccggatgtccagatgccccgcttgtcttgctgggtttcttccaaccatctcgtcatttaaagggaaaacaaaatctgagtctccagccaggaggcttctcccagagaggacaaaaaagcccaacttgccaccagatgctaaatgagacttgacagctgcagagcttgggctgtgctcatagctaagggttagggttcaatattagaaggagattaacattataagtgaaataatatgctctaatagattgtggagggcaggtttgagggacttagtttacctattctacactaacaagtgttgttttgggtccatgcctggaccatgtcacaaaaaggaggtgcccccctgtgctgtcactgtgaatggaaaggatgggtcacctctcttcatctgctgcttggaataaaaaatgcagctggccctgagtacagggaagtggaacataggcaggattttggattaatagagaaattttgataagaatggagacgctacgacagatgtaggaagtcatctacctttgatattagccatagaacttgaacactaactatatcctatgcatagtatgcagaacacttttctaagtttactttgagcctacttgcaagtggaagatatatatattctcacatggtttttacatttttctctatcgtgttaaaagctctaataatgctagtggagcagttgacatccagggttttttttcctgcctgtcatacttgctaaacaagagcacagcgggcctgtcagatgaagtcaggagccatacgtgaccgctcgtagaacacagtaaccaaacacatacatggattttgccaagtgctgccagtagccaaaacaaagtctttttagggcaatagaggaaattattttgtgtctcaggtgtcagtcttaggaatggaagtttaataacaaatgggccaaactcgcaggacattccttctatgagcgcttcagaattttgctgtgaacagtcctcttggacacaggttggggtgcccttgtttgggtttgttttggtggaaaacatcacaaacctggcacaccatttgaatatccctaatatcattccagtcgctttcctcatcagttgcctttctatttcagttcattcacagatctcacttctgaatgtgccacttccagtagacatgctggtcaaagagcagtcatcattggggtgaagtgttcttgacagtttaatatgattcacttttctccaaagacatgtaaaaggctgttacgaaagcttggcttctgtcatggagacggaaatgggcaagcttccttccgtagcctcttgttaatccttaaacattaaatatttcgggggtaatagagccactggtgagtaaaaacctatataaaaaccaaaattatagga

SEQ ID NO: 671 - DNA, 2024 bp, Homo sapiens
  CDS (117)..(1673)
gtgtctgggccagcaggtcgcagccggagctgtgcagctggctgctgtcacatcccttcctctcccagctgccttcagctgagcttaacgccagcagaggccgaaacacttcacaaatgcaacttgtcagctgggagacggcttccctgagttctgacactgttctaggagtaggaatcattatcccacgctatggagaaggaaaccaaggccaggtaaagttatgtagggcgcttaaagttgcagagccaggaataaagtccggattgggactcagacacagccgctgtcgctgccatctggcgcgccgcagactcccgagaacagccctggctgtcagcgggcaccagccgcttcctgtgcccatcgcggagactggaggggcgcaccacggccaccgagccagaggcgcttcaggaggcaagagaagtccccgcgcgctccgggacccggcgcagctcatggtgagcgccctctggggctcgagggtcccttggctgagggggcgcatcctcggggtgcccgatggggctgcctgggggtcgcagggctgtagttgggatcgcgcacaaaccgactctgcggcccagcccgaaatgctgccgccaaggagcaacggcaccgcgtacccggggcagttagcgctataccagcagctggcgcaggggaacgccgtggggggctcggcgggggcaccgccactggggcccgtgcaggtggtcaccgcctgcctgctgaccctactcatcatctggaccttgctgggcaacgtgctgatgtccgcagccatcgtgcggagccgccacctgcgcgccaagatgaccaacgtcttcatcgtgtctctggctgtgtcagacctcttcgtggcgctgctggtcatgccctggaaggcagtcgccgaggtggccggttattggccctttgaagcgttctgcgacgtctgggtggccttcgacatcatgtgctccaccgcctccatcctgaacctgtgcgtcagcagcctgaatcgaacctacgccatctcttcctcgctcatcaacttctacatccccatggccatcatgatcgtgacctacacgcacatctaccgcatcgcccaggtgcagatctgcaggatttcctccttggagagggccgcagagcacgtgcagagctgccggagcagcgcaggctgcacgcccgacaccagcctgcggttttccatcaagaaggagaccaaggttctcaagaccctgtcagtgatcatgggggtcttcgtgtgttgctggctgcccttcttcatccttaactgcatggtccctttccgcagtggacaccccaaaggccctccggccggcttcccctgcgtcagtgagaccacattcgatgtcttcatctgtcactatgccttcaacgccgacttctggaaggtgtttgcccagctgctggggtgcagccacgtctgctcccgcacgccggtggagacggtgaacatcagcaatgagctcatctcctacaaccaagacatggtcttccacaaggaaatcgcagctgcctgcatccacatgatgcccaacgccgttccccccggggaccaagaggtggacaacgatgaggaggaggagagtcctttcgatcgcatgtcccagatctatcagacatccccagatggtgaccctgttgcagagtctgtctgagagctggactgcgagggggagatttctttagacaaaataacacctttcaccccaaatggattccattaaactgcattaagaaaccccctcatggatctgcataaccacacagacattgacaagcatgcacacacaagcaaatacatggctttccagtactgctccctttatcatgtgtttctgtgtagtagctggtgtgcttagaaacctcaccccattgattgatagttcaaagaattggcagaagcagttgcaataaactcagtcaaatgtacccagcctaccagagatggaacaatgatcctgtgagagaagagagtatggtgctggctccttaaaaaaaaaaaa

SEQ ID NO: 672 - DNA, 1109 bp, Homo sapiens
  CDS (237)..(1106)
tttttcctttccttttccctttctcctttccctctccatagtgaagctaatgtactttgcacagtgttagcaattatcacccattcatcaggtattaattcatttcgatcccaagggcataggcttgatgtacaataaggagttaaggactgtgagttctctgataaggtttggttatagtcatttctcacttctcaccctctccaggactacttccagcaacccagtctcctgccatgtccgaccccatcacgctgaacgtcggggggaagctctatacaacctcactggcgaccctgaccagcttccctgactccatgctaggcgccatgttcagcgggaagatgcccaccaagagggacagccagggcaactgcttcattgaccgtgacggcaaagtgttccgctatatcctcaacttcctgcggacctcccaccttgacctgcctgaggacttccaggagatggggctgctccgcagggaggccgacttctaccaggtgcagcccctgattgaggccctgcaggagaaggaagtggagctctccaaggccgagaagaatgccatgctcaacatcacactgaaccagcgtgtgcagacggtccacttcactgtgcgcgaggcaccccagatctacagcctctcctcttccagcatggaggtcttcaacgccaacatcttcagcacctcctgcctcttcctcaagctccttggctctaagctcttctactgctccaatggcaatctctcctccatcaccagccacttgcaggaccccaaccacctgactctggactgggtggccaatgtggagggcctgccagaggaggagtacaccaagcagaacctcaagaggctctgggtggtgcccgccaacaagcagatcaacagcttccaggtcttcgtggaagaggtactgaaaatcgctctgagcgatggcttctgcatcgattcttctcacccacatgctctggattttatgaacaataagattattcgattaatacggtacagaggaagattcacggcccctgaggagatccagaggaaagagacggtctccaagggtgctgtgcagcaaggagcccaggagtggtatgaaccgtaa

SEQ ID NO: 673 - DNA, 1805 bp, Homo sapiens
  CDS (358)..(1212)
ggtggggacttccttccatgtctgtttcctggatgcggtattctcgtctggaggaaaaagctctttgacctcatggcgctttcccgagccgcagtgacgtcattaaatgctcacgcgtcacagcccaatcatagggccctttccctccctttagaagtcccgactgtccctgacacattccactccaagcgagccgcgacacttacgtcacgctccgcccgcccgcgcggtgatgacgtcacgactcagggctggcgtcacgctgtcccccgcggggggcgcccttgagggcggcgcttccggatcgcggagcctggtggccgcagcggcggtggcgacgacggccgagacgtggggatggcgggcgccgggagcgaagcccggttcgccgggctgtcgctggtgcagctcaacgagctgctggaggacgagggccagctgacggagatggtgcagaagatggaggagacacagaatgttcagcttaacaaagaaatgacacttgccagcaaccggagcctggcagaaggaaaccttttgtaccagccccagctggacacgttgaaagcacgcttgacccagaaataccaggaactccaggttctctttgaagcctatcagataaagaagaccaaattagacagacagtctagcagtgcttccttggagaccctgttagcacttcttcaggcagaaggggccaagattgaggaagacactgagaacatggcagagaagtttctggatggagaacttcctctggattccttcattgatgtctatcagagcaaacggaaactggcccacatgcgacgggtgaaaatcgagaagctccaggagatggtcctaaaggggcagagactcccacaggccctggccccgctgccccccaggctgcccgaactggcacctaccgccccccttccctaccctgccccagaggccagtgggcctcctgccgttgcacctcggcgcatcccccccccaccacccccggtgcctgcgggacgcttagccaccccgtttactgcggccatgagttcgggacaggccgtgccgtacccaggattacagtgcccgcccctgcccccccgcgtgggcctccccactcagcaaggattctcttcgcagttcgtgtccccatatccgccacctctccctcagagacccccgccccggctccctccacaccagccgggtttcatcctccagtgagcgccggcgcggtccttcccgggagacttcttccacctggcgtgttgtgctctgctcacgggaaggaggctggaggtccgctctgtgccaagggctctggggccctgggccagcgtgtctgtctgattttagaactgtaggtcagtggtgagtagtaggagcccaggctttgggcatcaaggcagttgtgtgtgccgggttacagcctgacacctgtgcgttgcatcggtttgcattatccgtgtgatttctaagtatcttagcgttgatgaactcatgtttgggaagaaataggcctctcccgcagtcccatttagaatcgtggtccttctgttgcagctttatttaatgagcatggttcatgatacttattttattttcgaaagacagtcctatgtgtctccgcaccggccgctgtcggggatgccacagccttccacggtcgcagccagacgtgagcttggcattgaagttgcaaacgcgcccctggccgggctcgccgtcgctgtccagggccgtgtccggtgctgtggctgtaaagctgtaggaccctttttaataaatagagaggtattaataaaaaaaaaaaa

SEQ ID NO: 674 - DNA, 390 bp, Homo sapiens
  CDS (37)..(303)
tttcctccttaataaaaccagaccctttgacatgaaatgactagacccctgcctctctctccagcctctccactggccactgctgccatagaatcttatgctcccaccatgccaaatttcttgtggttccctaaatgcgccatgtttgaagatactctgaggacattgtatatacttttgttctacctgagatacatttgcttactttctccacatattgccctcatgacacttatccttattgatggatttcttcaatgctactattgtgccttacatgtgccttgtattatagcatttttatagcatttctcacccaattgtggctattttgttacatgtctgtctccttggggggactgtgaactctgtcataacagatgccatttt

SEQ ID NO: 675 - DNA, 1832 bp, Homo sapiens
  CDS (62)..(526)
cggacgcgtgggcggacgcgtgggtcggtgcttggcctcgcccgcaacaccctcctggaggatgctggtgagaggcagggaccaggggtccggctcccggctcgggcctatcgttaggcgctgggcccccaggccctctcctttgcagagtctcgctgcctccctcgacgcagagccttcaagcgccgcagtccccgacggcttccccgcgggccccactgtctccccaagacgcctggcgaggccgccggggctggaggaggcgctgagcgcgctggggctgcagggagaacgcgagtacgccggggacatcttcgccgaagtcatggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgaggaaactgaggtccggaacttggggcctttccagggcagggagtaaagagcccggatccaagactccttcacctccccccgcatcccccatctgcagcccgccttcctctgcctcctgagcgcggactccttctcacgggcggagctgctgcgcgccgagcgtcgcatcctgagccgcctggatttccggctgcaccaccccgggcccgctgctgttgcctccgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggacccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccacttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccagggggccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttatttt

SEQ ID NO: 676 - DNA, 865 bp, Homo sapiens
  CDS (186)..(695)
tggcacgaggcctcgtgccggaaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctgccacctgggggccccgaagtgcacccgctgcctcatcaccttcgcagattccaagttccaggagcgtcacatgaagcgggagcacccagcggacttcgtggcccagaagctgcagggggtcctcttcatctgcttcacctgcgcccgctccttcccctcctccaaagccctaatcacccaccagcgcagccacggtccagccgccaagcccaccctgccggttgcaaccactactgcccagcccaccttcccttgtcctgactgtggcaagacctttgggcaggctgtttctctgaggcggcaccgccagatgcatgaggtccgtgcccctcctggcaccttcgcctgcacagagtgcggtcaggactttgctcaggaagcagggctgcatcaacactacattcggcatgcccggggggagctctgagtgcagcttaagcctctccacggtgacgggtggctctgtggctggtaggactcacccatgatatggggtgcaggaactctgggggccctgaaggatttgcttccctcccctgggaaggcagagggctcttaataaagaggacccagaagattcttaaaaaaaaaaaa

SEQ ID NO: 677 - DNA, 1359 bp, Homo sapiens
  CDS (38)..(1054)
agttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaagaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtactcgtacctatattaattatgcttacgccatgataaccaatatacagatatattaattggaattcctttgcataggagaatgtttttatgatctgtttagggcttattattttttttatgatctgtttagggcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatattta

SEQ ID NO: 678 - DNA, 2450 bp, Homo sapiens
  CDS (292)..(2199)
caatggcaatcttggtataagttgattgaagagggtatttattaaggttctggcatctagggcaaagtatgagctcatcttttacagaaagacattgttccttctactgttcattctaatcagagactctactagtctgtgtttgggaactgtagttcccatgatttctttaaatgtgtaggttagtattctttttaattttaaaaaattatttactgttttggtttataggaactttgcttacataccaagctgttagccccagttaattgtcccattgctgattttcttatgaaagctcctgaacctccaccagctttaattgtaagaaatgctgtacaaatgcttaagacaatagatgcaatggatacatgggaagatctgactgaacttgggtatcatttggctgacttgccagtagaaccacatcttggtaaaatggtcttgtgtgctgttgttttaaagtgtctggaccccatccttacaattgcttgcacactagcttatcgagatccttttgtactacctactcaggcctctcaaaaacgtgcagctatgctttgtaggaaacgttttactgcaggagctttcagtgaccatatggcacttctcagagcattccaggcctggcaaaaagcacgaagtgatgggtgggagcgagccttttgtgaaaagaattttctttcacaggctactatggaaataatcataggcatgagaacacagttgcttggtcaacttagagcatcaggttttgttagagcacgaggtggtggtgacattcgggacgttaacacaaactctgagaattgggctgtcgttaaagctgcattggtggcaggcatgtatcctaatttagtccacgtggacagagagaatctagtgttgacagggccaaaggagaaaaaagtacgatttcatcctgcttcagttctcagtcagcctcaatataaaaagattcctccagccaatggtcaagctgcagcaattaaggcactgcccacagattggcttatttatgatgaaatgaccagagcccatagaatagctaatattagatgttgttcagcagtgacgcctgtcactatattggtattctgtggaccagctagattggcaagtaatgctcttcaggaaccttcatcctttagagtggatggcattcccaatgacagtagtgatagtgaaatggaggacaaaactacagctaatttggcagccttgaaacttgatgagtggctccatttcacactggagccagaggcagctagtttattgctgcagctcagacagaagtggcatagcttatttttacgccgaatgagagctccatctaaaccttggtctcaagttgatgaagctaccataagagcaattatagctgttttaagcactgaagaacagtctgcaggtttacaacaaccatcggggattggccaaaggccaaggcctatgtcttcagaagagcttcctttggcctcatcttggaggtcaaataatagtaggaaaagttcagcagatactgaattttctgatgagtgtactactgcagaaagagtactgatgaaatctccatctccagcattacacccacctcagaagtacaaagatagaggaattttacatcctaaacgaggtactgaggaccgatcagatcagtcttctctgaaatctacagacagcagtagttacccaagtccttgtgctagtccttctcctccatcctcaggaaagggctcaaaatctccttcgccaagaccaaacatgcctgttcgatacttcataatgaagagtagcaatttgagaaaccttgaaatttctcaacagaagggtatctggtctacaactcctagtaatgaacggaagctaaatcgagccttttgggaaagcagcatagtttacttggtattttctgttcaaggatctggacatttccagggattttctaggatgtcttctgagattggaagggaaaagagtcaggactggggctctgctggactaggaggagtatttaaggtggagtggatacgaaaagaaagccttccctttcaatttgcacaccatttactcaatccatggaatgacaacaagaaagtgcagataagcagggatgggcaggaactagaacctctggttggtgaacagttgctccagttatgggaacgtcttcccttgggagaaaaaaacacaactgattgacactcagaactcttagctgtggaagaacatcatgcctatttataaccactgaatgcactgactttcaaaaactgaggtggggtgtgtgttacgaatgggctttttaacacttttagagtgttgctttagaactaccatcttcatatacaggagaaaggaagcatttaaatttttatagtgattatagagaatgattatatgatgtttgtaatgaataaaatagtagtttcattattaaaaaaaaaaaa

SEQ ID NO: 679 - DNA, 1123 bp, Homo sapiens
  CDS (49)..(873)
gagcgtgggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacgtagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtcggggacctcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttgtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagctcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtaaaaaaaaaaaaa

SEQ ID NO: 680 - DNA, 1560 bp, Homo sapiens
  CDS (81)..(1313)
cggaaccgtaggaggggtacttaaccggacggcctaccaggcctgtggccgtgcgcgggaagagcactgcagatctcaggatgatggggcgcagccctgggtttgccatgcagcacatcgtgggtgtgccccacgtactggttcggaggggcctccttggaagggacctcttcatgaccaggactctctgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattatttaaaaaaaaaaaaa

SEQ ID NO: 681 - DNA, 1821 bp, Homo sapiens
  CDS (266)..(1261)
aaggatccttaattaaattaatccccccccccccaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggccaagggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaagtgtgaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaacatataaaaaaaaaaaa

SEQ ID NO: 682 - DNA, 1326 bp, Homo sapiens
  CDS (1022)..(1297)
accaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatgattttacctatacttggtaatgctttgttttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtagtccttaaatttgaatccgtcagcacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaaaaaaaaaaa

SEQ ID NO: 683 - DNA, 1656 bp, Homo sapiens
  CDS (321)..(809)
tttcgtcttataccaaacacatcaaactccaaagaaaaagaacattgcccgagagagagaaacagcatctataagcggcattaaaacacaccaaggaggagacggaacttttcgcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacaatatgtcgctcttgggacccaaggtgctgctgtttcttgctgcattcatcatcacctctgactggatacccctgggggtcaatagtcaacgaggagacgatgtgactcaagcgactccagaaacattcacagaagatcctaatctggtgaatgatcccgctacagatgaaacagttttggctgttttggctgatattgcaccttccacagatgacttggagtgctgggatgagaaatttacctgcacaaggctctactctgtgcatcggccggttaaacaatgcattcatcagttatgcttcaccagtttacgacgtatgtacatcgtcaacaaggagatctgctctcgtcttgtctgtaaggaacacgaagctatgaaagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataaaaaaaaaaaa

SEQ ID NO: 684 - DNA, 1557 bp, Homo sapiens
  CDS (16)..(798)
attcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatggctgtgactgaatatatccccccgaaaccagccatccacccatcatgcctgccatctcctcccagccccccacaggaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagctgagaaattatgaggcttgcttaagagcatgcaggtaggaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctaaaaaaaaaaaa

SEQ ID NO: 685 - DNA, 428 bp, Homo sapiens
  CDS (14)..(310)
gaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaacaaaaaaaaaaaa

SEQ ID NO: 686 - DNA, 386 bp, Homo sapiens
  CDS (14)..(268)
gaaacttgacgccatgaagatcccggtccttcctgccgtggtgctcctctccctcctggtgctccactctgcccagggagccaccctgggtggtcctgaggaagaaagcaccattgagaattatgcgtcacgacccgaggcgtttaaggctgatgagttcctgaactggcacgccctctttgagtctatcaaaaggaaacttcctttcctcaactgggatgcctttcctaagctgaaaggactgaggagcgcaactcctgatgcccagtgaccatgacctccactggaagagggggctagcgtgagcgctgattctcaacctaccataactctttcctgcctcaggaactccaataaaacattttccatccaacaaaaaaaaaaaa

SEQ ID NO: 687 - DNA, 1108 bp, Homo sapiens
  CDS (1)..(1065)
atggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaaaaaaaaaaaa

SEQ ID NO: 688 - DNA, 544 bp, Homo sapiens
  CDS (1)..(501)
atggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaaaaaaaaaaaa

SEQ ID NO: 689 - DNA, 2297 bp, Homo sapiens
  CDS (58)..(2202)
tttcgtgtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccgcctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggatagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgt

SEQ ID NO: 690 - DNA, 1089 bp, Homo sapiens
  CDS (298)..(693)
cggcgggcaagccccgcgtgctgtgccatgaggcagaggtcttcctgtccaccgggagcgagctcgtctacgtgtacgaccaggagggcgggctgctgaccgcggcgttccggttccccgaccaggtgtggcacctggagctgctggcgccgcgcaggttgctgtacgcgctgtgcgcccggaggggcctctactgcctgtcgctggaccacccgggcaggagcaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaag

SEQ ID NO: 691 - DNA, 2072 bp, Homo sapiens
  CDS (163)..(1743)
gtgtggccatccatctgagtttgatgaaatattgaatgctatatcatatagcaaaggtgcatctgtcatccgaatgctgcatgactacattggggataaggactttaagaaaggaatgaacatgtatttaaccaagttccaacaaaagaatgctgccgcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaaa

SEQ ID NO: 692 - DNA, 2084 bp, Homo sapiens
  CDS (163)..(1755)
gtgtggccatccatctgagtttgatgaaatattgaatgctatatcatatagcaaaggtgcatctgtcatccgaatgctgcatgactacattggggataaggactttaagaaaggaatgaacatgtatttaaccaagttccaacaaaagaatgctgccgcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaaa

SEQ ID NO: 693 - DNA, 2294 bp, Homo sapiens
  CDS (259)..(1401)
cagaggctcgggaaggggcgtggatccccggaggcggtccccgggttgcagtgagggaagtgggccgggaggagagatgggcggtgaagaggcccggccctgccagggaggcgggcggatccgtggcagtgaccagaaggggccggaagggggtggccgccggccgggccccgccctggggccgcctccccgcgggttccgttggctgtgggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgacctgtccaggaaggattagaccctgtactctccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttatagctcccaggttctttcagtaatgttatttgctctgtgtgtttttgtgtgtttgttgatgggcgtttgtgcatatgcgtgagtttcattgccggggttggggcacaattgtggactggggccatgaggccttccctggtccccactgaacccaccttagttccacatttgggtgcatcttgaattatgccgactccagacttctcctccttttttgcccttggctcttgaccctttaaacccctggaccatttgaatggagcagccaagttcagtcccccatttttgtactgttcctctttcccagctggaatatgtcccatgatgaagttgtatagaaacagacccatggatggatggccaggattcccgtggtccctagctagatccccttcctatcaatcccctgatagcaacagggacagctgccaatcccctgctctttactcaatggtacccagggagggagcatgggaaaagggtgagctgagggctggaggagggcaccaccccctgggtgagctgttcccggtcttatactattgtttgtgattaaaagtgcttccccccaaaaaaaaaaaaa

SEQ ID NO: 694 - DNA, 1118 bp, Homo sapiens
  CDS (225)..(905)
tttcgtgcggtcgggtccgggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatcaaaaaaaaaaaaa

SEQ ID NO: 695 - DNA, 2001 bp, Homo sapiens
  CDS (303)..(1508)
ctggactcatttacttttacagttatatcatagacttgctttctggcactggtttcctggaggaaactagcctcttttacggacattacaccattgatgaggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacagtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgccttttatt

SEQ ID NO: 696 - DNA, 1866 bp, Homo sapiens
  CDS (211)..(441)
ggggtgggtgggtgaggaggagagagccacaaaatgataagagtggagagcagtgtggggccctccctttgagggaaagccgttgtttacatagggtagtaggccttgttggcctgatcaagagatgaagccataactcttaaaaaccttcagaaccaaacgctgtgtctgcatccatctgttctcactggccctctgcatggtaaagttatgtcaccacaaagtgatgccgcattacaatcacttatgaaactgttagcccttaatatgcatcacatttgtggttccatagtgcttctcctttgcttgtttgatctctgcatggcagcagtggggcagctccacatttggagcccatactccaaaatgcagagcactcttctcacagcacacattcccagccccaaacaaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatgctttggaaacctgccagagcacttaccctgctggaagattaatgaagactccattctgtgtttcataacagtagcgttgttttctccatcaaaaacagagggtcacagaaatgtgctgaaaagatgtggtccagcaaggttctgtagtcccacctcagtgcctgtgggctgtgtttttcactgtaacaagcactttggtaaactagaaagaagaaaggattctcaggatgtgttcaaagctaagagagttttcattttaaaaagaaacatacatactcactccatggctttcctcatcctcctctcttttttcttcttggtgggaagctggatgcggggcatgcatcattctgtatggacaaatgtgttatgtccacccatactcttgtgacaactccccagcactgtcctgcaataccatgctggccttggtagtaaaactccttggtatctgtgagagtcctctttttctatgccctagactacttttaaccacttttctctggaatgactcccacatttggttgggtattgaaagggtaacagcaaaatgatgattgtggagatggatctattaggtctcatgttggtcccctggttgaaactattttcaaaaaagccccaacaatgggcctgtcaccttgctagtcatccattcttaatgcctatttatcagccctctgaggtcatataaaagttgcaccttttgaaccaagtatttgtatttactatgggaaaggtgtggactacagattcgtattatattattttaatggattttaagtaatttataagtatgctgagtgtaaattttttttaaaaactgtattataaaaggacatatcctgtgaaatataacattttactgtttaatagaataattctataagaagaatgatttatctcacccacggaactgattacattccggatgcaatcaataggcactttgtaatttcctttttgtttttttttctttgctggggggttgaggggtaacaagataccatctgtataaagtgcagtttgtgtcactcaaaatatgcactgtatggctacacaaaagcagcttgatgaacaaatcaccccatggctcattaaagaacaaagcttccagaagcaaaaaaaaaaaa

SEQ ID NO: 697 - DNA, 658 bp, Homo sapiens
  CDS (228)..(455)
tttcgtgggcgggatgtaaccggctgctgagctggcagtcctgtgtcgctaggcttctgcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctggctggcagcctgctatcaattacattgatagtaaatttgaggactacctaaatgcagaatcgcgagtgaacagatgtcagatgcctggtaacagggtgcagtgttgtttatacttcattgctccttcaggacatgggtggcagacaagaaacatggattattgcgtggagttccattagtaggaataagactcattctacattcttgttgttcttagtgttttttgtttttcatgagaaggaattgtatcagcacaaggcaatattctaacatgacaatgacagcagacagaacctcaataaactctgacttggtactgcaaacaccatttcatgataccttaattcaaataaacctttgtttaatcaaaaaaaaaaaa

SEQ ID NO: 698 - DNA, 1023 bp, Homo sapiens
  CDS (31)..(1020)
ggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggcttgtttgtggtagttggaggcgtcatgtcggtgctgggctttgctgggctgcaattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtag

SEQ ID NO: 699 - DNA, 1629 bp, Homo sapiens
  CDS (73)..(1563)
aattctctggtcgacgatttcgtcctggggttatgacccaagaggttggcctgctcctgcaagacatgggtgatgatgtataccagcagtaccggtcacttacgcgtcagagcagatgactttgatacgcagtcaggtttttccattaatagtcaggtctttgctgcagatggtgcctccactgagacttccgcatctgggacctcccaaggagaggcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggttgagaatgagctggaggacctgatagatgagttgcttgagagggatggcggatctgggaacagtacaattatagtgagcagaagtggagaggatgaatcacaagaggacgtgctgatggatgaagctccttccaacctcagccaagcttccaccttgcaggccaaccgagaagattccatgaatatcctggaccctgaggatgaggaggagcacactcaggaagaggacagcagtggcagtaacgaggatgaggatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagccttagcagggccctgtctgtcccaactgtttgaacagtgagctcctcagaaaaaaaaaaaaa

SEQ ID NO: 700 - DNA, 2318 bp, Homo sapiens
  CDS (644)..(2116)
ggactcgggacatgctgctagatgctggggttcctgccgttccacttggctgcgggtccgcaaggcccggccccagctcatcctcagccgccggccccgccgccggctcgggagcctgcgctggtgcggtcggcggcgcctactggcggcggttactgcaagcccaggcggccggcgtggaactggagggagggagcccgccaggatgtcgcgcgcggcaggcggcccggagacccaacaaccgggacccccagacccgatccctaggcccgaccccggcctccgaaccccgaggtccgaacccgaactcgaatccgcctcgatgttgccaccgggcctcttctcatcccaccggtgcggcccgtgtgcccctggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattaacaacagtgttttttgtgtaattcgtgaatgtcatatagtagtcttaagtttctcttttaaagctgcatgagctagaaaaaaaaaaaaaa

SEQ ID NO: 701 - DNA, 1070 bp, Homo sapiens
  CDS (332)..(652)
ccggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtgggtggcatttaaggtcaaaacccagccagaagtgctggtgctgttaacaaagtctcaggtggtgcggtgggggtcatgctgtatccaaatttggaggccgcggaaacatgttggccccggtcaatcaccgggacctagatcccctcataatac

SEQ ID NO: 702 - DNA, 971 bp, Homo sapiens
  CDS (332)..(553)
ccggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtgggtggcatttaaggtcaaaacccagccagaagtgctggtgctgttaacaaagtctcaggtggtgcggtgggggtcatgctgtatccaaatttggaggccgcggaaacatgttggccccggtcaatcaccgggacctagatcccctcataatac

SEQ ID NO: 703 - DNA, 1623 bp, Homo sapiens
  CDS (129)..(1496)
aaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggatgaaggagagacagatgaagacaaaatggaagaatataaggatgaactagaaatgcaacaggatgaagaaaatttgccatatgaagaagagatttacaaagattctagtacttttcttaagggaacacagagcttaaatccccataatgattactgccaacattttgtagacactggacatagacctcagaatttcatcagggatgtaggtttagctgacagatttgaagaatatcctaaactgagggagctcatcaggctaaaggatgagttaatagctaaatctaacactcctcccatgtacttacaagccgatatagaagcctttgacatcagagaactaacacccaaatttgatgtgattcttctggaaccccctttagaagaatattacagagaaactggcatcactgctaatgaaaaatgctggacttgggatgatattatgaagttagaaattgatgagattgcagcacctcgatcatttatttttctctggtgtggttctggggaggggttggaccttggaagagtgtgtttacgaaaatggggttacagaagatgtgaagatatttgttggattaaaaccaataaaaacaatcctgggaagactaagactttagatccaaaggctgtctttcagagaacaaaggaacactgcctcatggggatcaaaggaactgtgaagcgtagcacagacggggacttcattcatgctaatgttgacattgacttaattatcacagaagaacctgaaattggcaatatagaaaaacctgtagaaatttttcatataattgagcatttttgtcttggtagaagacgccttcatctatttggaagagatagtacaattcgaccaggctggctcacagttggaccaacgcttacaaatagcaactacaatgcagaaacatatgcatcctatttcagtgctcctaattcctacttgactggttgtacagaagaaattgagagacttcgaccaaaatcgcctcctcccaaatctaaatctgaccgaggaggtggagctcccagaggtggaggaagaggtggaacttctgctggccgtggacgagaaagaaatagatctaacttccgaggagaaagaggtggctttagagggggccgtggaggagcacacagaggtggctttccacctcgataattgttgaagacattgaacctattcatcctcctctaaccttctttattggaattaaatttcaagtgggagacttaactttagaactcacttccagcttgcactttgctttaatttctctgagctg

SEQ ID NO: 704 - DNA, 1928 bp, Homo sapiens
  CDS (89)..(1015)
tgtattggaccgagttccagatgggccagtatttattgctatgtgttttctagtgagagtaatggatgcagttagctttgctgcagcaatgactgcatcttcttctatcctggcaaaggcttttccaaataacgtggctacggtattgggaagtcttgagactttttctggactggggctaatactaggtcctcctgtaggtggctttttgtatcaatcctttggctatgaagtgccttttattgttctgggatgcgtcgttttgctgatggtaccactcaatatgtatattttacccaattacgagtctgatccaggtgaacactcattctggaaactgatcgctttacccaaagttggccttatagccttcgtcatcaactcactcagctcgtgttttggcttcctcgatcctactctgtctctctttgttttggagaagttcaatttaccagctggatatgtgggactagtattcctgggtatggcactgtcctatgccatctcttcaccactatttggtctcctaagtgataaaaggccacctctaaggaaatggcttctggtgtttggcaacttaatcacagccgggtgctacatgctcttagggcctgtcccaatcttgcatattaaaagtcagctctggctgctggtgctgatattagttgtaagtggcctctctgctggaatgagtataattccaactttcccggaaattctcagttgtgcacatgaaaatgggtttgaagagggattaagtacattgggacttgtatcaggtctttttagtgcaatgtggtcaattggtgcttttatgggaccaacgctgggtggatttctgtatgagaaaattggttttgaatgggcagcagctatacaaggtctatgggctctgataagtggattagccatgggcttgttttatctactggagtattcaaggagaaaaaggtctaaatctcaaaacatcctcagcacagaggaggaacgaactactctcttgcctaatgaaacctagtccgatggatcctggattgatacaaggttgagaaatgaatgctcctggccttaaacatcaccgtaggaagggtttttaaaattttacgcgcaaaactccgtggaccccgtgccagtgtcttggaagtgtcaacgtgtttttggatgatcctgtattgggctgtacttactgtgatactgaaaagctgtcctgctgaagcagctatatttgaaatattaagtatgaaaggagtaattaaaaacaagcaaaacaaaacaagacttagtttttaaatgaccaaacttgtccttaaagatgttgttattaactcgagttagttcttatttcctctgtttattttttattctaagtacactgattctgtgaatgtaccttttttattaacagggaaagaaatgaattaatttgatatgctctaaatacataaaggtgcttcaaaatatgtagaaacattactatgaaatcagtttttaaaagatatactttctctttgtcctgaggtttttcggtcttgttcaaaaggaagaattcttgcctgccatacagaaactctctagcactccctgaccttaagcttttctaaaaattctgtttgtgtgaaaagtacaagaataacaatacttacaacttccatttttgtaacctacgttcacttatgatctggatttataaacattacttggtataacgtttttcatttcctttaatgtctctgttttttggctctaccatctgttttgtttttgtttttatctatattcttggtagatgtatttcatccctagagcaggtcagcctccttcccctaatgcgaatgcttgttttgttagggaagggcttcctccaacttcgtgtgaaattgtgatgttgaagtgaataaatgtctattgtgtaaaaaaaaaaaaaaaaa

SEQ ID NO: 705 - DNA, 419 bp, Homo sapiens
  CDS (26)..(238)
ccacgcgtccgctgtccacttcgccatggagaagatcctgatcctcctgcttgtcgccctctctgtggcctatgcagctcctggcccccgggggatcattatcaacctgacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaaccttaaaaaaaaaaaaaaa

SEQ ID NO: 706 - DNA, 4112 bp, Homo sapiens
  CDS (391)..(1173)
accggaattcccggggcgacgatttcgtgcttcctgtcccacatctttctcacggtggcgcctggacacagcagccaccacagtccaggggtgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaacgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttagagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaaaaaaaaaaaaaaaa

SEQ ID NO: 707 - DNA, 1699 bp, Homo sapiens
  CDS (215)..(484)
cacgcgtccgcccacgcgtccgcccacgcgtccgatctcatcatattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgcctttggggatttatgaggattttttttggtggggggagggggctccaattcatatctctgaaacccttcacacttggtttactaattcaaagttagaagtctagaatttgccctgccctaacagaaacagattaggaatttgtctacacaaactggtgtcacctgtttcttgactgggatttggtttcctcattataaatatgggaggtagaacagagatctccaacgtctctcccatttatcacagtaattttcttattcacagtaatcattgttggatgttaccttttcagcttcacattctcaagatggtaaaaatcatgtatatagattatcagaactctaagcaaagatgactgtcacatctgaagctgaggtgccttaggtactctactgaccttgatgggtttggagttccccattgcttatcaagagctttttaattgctttggttctttagtttttctttttgcaaaaatccttcctgtcactttaactaaaaaccaaagatttgttttctattgataagcagactagagaaaaactgccttattttcagaagcatgtcttcattcaaagcttaggcttcaatagaaattcagactaatcactgaaatgactatttcaaactagtgaaatatctgggaaataaactgcttcaaaaatattttactgacatgaattttgctagtgaatacaaatacactgcctcaaataaggccatgtatgaatgaacttacaagatatttgagttaatcagtgtttgcatatagagaattagttctaaagttcttaaaaataaatttaggggctccctgaaattttatttaatactttgctaacttacactcttgttttatctccacaggtacattttaggttagctcatggtgaattctatttacaataagtggagcttggattaatgggttttgttatgaattatcttagtgactttagacactgtttccatttgatttttaactatttaaaataccaaattaaataccagtttgttggttgttacttttaaatgattgttactttaacagtgtcccttcttaacacatggggttacaaataaaatactatgcatagcaaaaaaaaaaa

SEQ ID NO: 708 - DNA, 1373 bp, Homo sapiens
  CDS (36)..(1370)
ctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaa

SEQ ID NO: 709 - DNA, 1189 bp, Homo sapiens
  CDS (136)..(654)
tttcgtggcagcagtagcgggagcagcagcgtggacgcggctggcgctggcgccatgaacccgctgtaaggcgcaggctgtgcagcacggggtgcgggggaggaggaggaggacgccgcggtgaagttctccgccatgaacctgaggggcctcttccaggacttcaacccgagtaaattcctcatctatgcctgtctgctgctgttctctgtgctgctggcccttcgtttggatggcatcatacagtggagttactgggctgtctttgctccaatatggctgtggaagttaatggtcattgttggagcctcagttggaactggagtctgggcacgaaatcctcaatatcgagcagaaggagaaacgtgtgtggagtttaaagccatgttgattgcagtgggcatccacttgctcttgttgatgtttgaagttctggtctgtgacagaatcgagagaggaagccatttctggctcctggtcttcatgccgctgttctttgtttccccggtgtctgttgcagcttgcgtttggggctttcgacatgacaggtcactagagttagaaatcctgtgttctgtcaacattctccagtttatattcattgccttaagactggacaagatcatccactggccctggcttgtatgtaacttttaaaatccttaaataaagttcttttttattataaaagtaattcatattcactgtacaaagcttggaaaagacggacaagcagaagtaatagcctaatagtcacccataatcccaccatggggagataacatggttagtgtttttatgtctgtgttttatacaaacagtttggatataactgtgtgcaccattttgtatcctgatttttttgttttaatgttgtatcataaacattttatcatgttaataaaaggtctttataaacatgacttctaaagtttaattgatacaaaatattcttcaagtgcatgtatcagaccatcctcttatttctaaaatatggtatttccattgttgccagtgttgaatgattttaaatcatactgcagtatatatgtttatgcattaaaatttttgccttttgttttttggttgttttcttaggaaatagtccagaaatagtgttactgagctagaggttgggaactatttgagattcctatatacgtatactgcactgccaacttgcttttcc

SEQ ID NO: 710 - DNA, 604 bp, Homo sapiens
  CDS (38)..(484)
cgggccggaactcccgggtcgacgatttcgtggattaatgaggctaggcctcaagccccctcgattcccgaagttgttttcctccatgggcgccttgtgccgtcaccgtcggcgacggctttggcatgccgttttcaccgaggaaaaggactcgtatcgtatgctcgctatccagaacctacactctgtcgacccctttgctgatgccagtgaggttgacgacctgcttcatgctggcactgaagatcatatccatataagacctcaacagagaaacggaaggaagacccttactactgtgcaagggatcgctgatgattacgatcaacagaaactagtgaaggcgtttaagataaagtttgcctgcaatggtactgaaattgagcatccggaatatggagaagtaattcagctacagggtgacctacgcaagtacatatgccagttcttcgtagagactggactggctaaggacgatcagctgtaggagcatgggtcggaagagcacatggtacactggcgttgatagtgaggcagtcgttgcaatggatagtatctccattcttttccagaccaccagtctttttactggcgcatgcttcaa

SEQ ID NO: 711 - DNA, 1569 bp, Homo sapiens
  CDS (716)..(1372)
ctgggagttctagctagggtttgcagctgcagctagagttaggggttggttttgaagctggagctaaagctaaatcggggtcggagctgtggaatgggttggcgcccaggctctggggcagatagacgacattcctcctgctgcccaggtctgcgaattgtgttccgagccctaactgcagcggacagaagcccctcccttcacaggaatgcctcagcccagcagaaggagcagtgccacgtcagccaatcggctcaggccctgccctggaaacgacacctgttcatcctcctcccggcaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgcaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacccatccccatcaaaaaaaaaaaaaa

SEQ ID NO: 712 - DNA, 1673 bp, Homo sapiens
  CDS (346)..(1146)
gttagtccgtaccagggacgcctggtaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaaggaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaagataggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaaacgtgccttggcgataacaggaggcagcacagaaaaggcaaaggacaaagggaaaaggaaataaaaaaaaaaaaaa

SEQ ID NO: 713 - DNA, 2425 bp, Homo sapiens
  CDS (174)..(1421)
gtcgtgatcagacgagcggtgagcgatcgatactcctatgctagcctctggctcctcaggggacacagccgagtggtcggaccaaacgcaacgagtcttcgccagcccaaaggcgactcgacaccgtcccagctgaagagaggcatgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctgggctactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgcgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagtgcgaaggtcttgctggatgacttttcacccgcactcacccaggagcaggctcccaagtgaagaaaccaccaaaccatcaccagctcctagaagcctccctcccaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccaaaaaaaaaaaa

SEQ ID NO: 714 - DNA, 4899 bp, Homo sapiens
  CDS (3405)..(3695)
tttcgtgtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgacgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaactaaaaaaaaaaaa

SEQ ID NO: 715 - DNA, 1813 bp, Homo sapiens
  CDS (249)..(1559)
ggaggcaggaggagcaagaagtggaaacaagagcagtgccgtcccctcctcctccccccatcgtgaagaagccattgaagcaaggtggggccaaagctccaaaagaggctgaggctgagccagccaaggagacagcggccaagggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagaatgtgcactccttgcaggcaggggctgggctggatgctgctcttgtgtcccacgtggtacttagttcaaggctgccccagcagatgcttaataaacagctcttcactttcctggaaaaaaaaaaaa

SEQ ID NO: 716 - DNA, 2554 bp, Homo sapiens
  CDS (324)..(2276)
catcacccccaccccagccccccaccacccccggcctaagcagctaccatggcccaggtggccggcgcggcgttgtcccaggcgggttggtatctttcagatgaaggcattgaagcttgcacaagctctccagacaaagtcaatgtaaatgacatcatcctgattgctctcaatatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaataggaaaagactctttgtgaagaaacgagccagtgactgaaacaccctggtggaaacctgttgacagaccttccactttctcttcagaataagtagctgtggtggatattattatttgaagaaagaaaaaacagattttagggtggaaaaaacagtcaactcacacaaagaatggaaaaaaatactgagttaaattaagcaaataccttttacaagtgaaaggaagaatttttcttctgccgtcaataaaaccattgtgctataaaaaaaaaaaa

SEQ ID NO: 717 - DNA, 480 bp, Homo sapiens
  CDS (86)..(346)
tacgaggccggtagtgagaacccttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacacccagtgcgaaaccctcatccagttttctctccatctcttttctttgtacaatcccatttcctattaccattctctgcaataaactcaaatcacatgtctgcaaaaaaaaaaaa

SEQ ID NO: 718 - DNA, 2384 bp, Homo sapiens
  CDS (285)..(1133)
aagccgattggcatgaagtgtactaaagggactaaggttgcggccgcgggtgagtctcgtccgctcgcgctgcccaccgcgtctccatcagctccaggcgcggttccccggcccgcgccgctcccggccccccggctcgggcgcctcccgccgcagcgcaggctcccccgccggccgggctcctgcgcggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctaccagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgaggggagccagaagtggcaataaaagcgtgttgacctgggctacgcgggactccatgaattttccattctggcaactggaaggggaggtgtagaagggccctgcagaggacggcactggagactctcctaaacgccacacacctcccccttgctgcccgccacacgcgcgtctccttcaaccgatgcattgccaccctcccacagcctcgccctctgctctaaattaggtcgaaagagtcccagttccaatctaggaacagcataattttgttccaaaacctgatctgtgtttttctaattaaaattaatttgtcacccaaaaaaaaaaaa

SEQ ID NO: 719 - DNA, 1837 bp, Homo sapiens
  CDS (1155)..(1403)
actctccatgctgagggtctgggagcacaggatctcgcagtgcctctgcagggcatccagctggaacaggctggcagctgacagcagctggtagggaggcagagcaggtcttggggacccatggccagaccagtggcccagacagcaccgaacagaaagctcccgagtgccgtgtgccctgctgcctccaccctcaggccccactaccttctgatactcctgggcctaaccatccccgctgggacacgcactgaggctgggctcagtggtgtgcacagttcctctttctgggaactgctcttcctgtcagatggagaggaagagccaccttccctctgaagggggtgaatgggagaccgagccgctgggcaccctggcccaggccccctccccctctcccgagtctcacctccaggatgtcagtggtggggatctccatggattctgttcctccgtagtacagatactgcatcatcatctgtggtgggaagaggcccatgtgaatgccacgtgaacctgaggcatgaaagtccttgccagccccacagggtactgctccagctgccgcctccaggggcctgtccctctgcaggtccccagctctgtctctccctccctctcctgctcaggctgagacttgtgttttcccggggaagccaactccaagaccctctctcctgagtccctgcccggataacaggctctctccttggaatgttttccctacaatcctcatgagaacacgctatgtgaccttgagcaagttactcaacctctccatgcctctgactcctctaccaagaggggataataacatacctacctccctggaactgtgctggaggcctcaatggaaaccaagcaaagcacttagaaccctgcctgcctaagtgttagtaatggctgcccagaccacctgtccagcggttagagctcaggacccatgtgacaggctctgaagctgcagccccacaacggatggctacctctgcacagggaaagacctggatgctctattcattcaacagaatacagaaggcactgggaatagagtgaacaatgacaaccaatgcacagctgcccacaaggtgggctcctgggggagggtcatccctctgagaagagggcggcaccaagacccacacacctgaaaaatgtggtacttcatgtcgctgatctcgatggtcttgctgctgtccccatcctgttctgatttattggtcattagtgtcttgaacctggagcaaaggagacaaagcaaggtgggttttgaaccttttacttcaccactgtgtggcgatggcaccatctgtcacctgaccggctaccacaagacggaacattttaaaaattactgctgtgctcctaaaataattttcagcaagtgccattttacaccatcttaggaagacatctgagctgagcccaattctgtccccaccacccaccctacaagcgacctgacgcctgtggccagaatgctgactcttcattccaggatatttatgttttctaataataaaagcaataactaggccagaaagaacaccacctcagagcccccctttcctgctgccctgggtccaccccgtctcatcccgctgtggggcgagtggggctctgctgcaatgtgactgcagtctgaggggcagaggctgcagggtacagccccagcgagtcactctctgtcacctggaatctgaaacaaggtgcttctgtgcccctgggctgggagtttgttatctgaggctgcctacctgttagaagctgtcaccagcaggactttatgtgcataaaacagctttccttccaccaggaaggtcacaaaaaaaaaaaa

SEQ ID NO: 720 - DNA, 1431 bp, Homo sapiens
  CDS (43)..(1341)
tttcgtagaggcggcaaattgcaaggagacgccgccgccttcatgctgccggcgggctgctcgcgccggctggtggccgagctgcagggcgccctggacgcctgcgcacagcgacaattgcaattggagcagagcctgcgcgtttgccgtcggctgctgcatgcctgggaaccaactgggacccgggctttgaagccacctccagggccagaaactaatggagaggacccccttccagcatgcacacccagtccacaagacctcaaagagttggagtttctgacccaggcactggagaaggctgtacgagttcgaagaggcatcactaaggccggagagagagacaaggcccccagcctgaaatctaggtccattgtcacctcttctggcacgacagcctccgccccaccgcattccccaggccaagctggtggccatgcttcagacacgagacccaccaagggcctccgccagaccacggtgcctgccaagggccaccctgagcgccggctgctgtcagtgggggatgggacccgtgttgggatgggagcccgaacccccaggcctggggcgggcctcagggaccagcaaatggccccatccgctgctcctcaggccccagaagccttcacactcaaggagaaggggcacctgctgcggctgcctgcggcattcaggaaagcagcttcccagaactcgagcctgtgggcccagctcagttccacacagaccagtgattccacggatgccgccgctgccaaaacccagttcctccagaacatgcagacagcttcaggcgggccccagcccaggctcagtgctgtggaggtggaggcggaggcggggcgcctgcggaaggcctgctcgctgctgagactgcgcatgagggaggagctctcggcagcccccatggactggatgcaggagtaccgctgcctgctcacgctggaggggctgcaggccatggtgggccagtgtctgcacaggctgcaggagctgcgtgcagcggtggcggaacagccaccaagaccatgtcctgtggggaggccccccggagcctcgccgtcctgtgggggtagagcggagcctgcatggagcccccagctgcttgtctactccagcacccaggagctgcagaccctggcggccctcaagctgcgagtggctgtgctggaccagcagatccacttggaaaaggtcctgatggctgaactcctccccctggtaagcgctgcacagccgcaggggccgccctggctggccctgtgccgggctgtgcacagcctgctctgcgagggaggagcacgtgtccttaccatcctgcgggatgaacctgcagtctgagcctttcccatgctgccctcggcctgttcaaatggggattgggggtgtcttccctggcactgtgctcggggacccagagatgcctgt

SEQ ID NO: 721 - DNA, 3529 bp, Homo sapiens
  CDS (1145)..(2755)
ggcacgagggacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgccccccttaaagcgccaccagacgctgcgccccgttaaagcgccaccagacgccgcgccccgtcccggcctcccccgcgcgctggcgcggggctttctgggccaggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaaaaaaaaaa

SEQ ID NO: 722 - DNA, 2472 bp, Homo sapiens
  CDS (136)..(2469)
ggaggagcgccgggcaggtgacgggcggtggcctcccggatctggggtaacgcttttgtgaaccacaactttaaatatcagccagctgctcctatcaacacgagtatcccctgttaattttttgcatttttcaagatgagtaaacgtaaactaattcccaagctctctattcaatctcctgtccttcataccaacttaaatgtccagtccacacacccacctttgaagaaagaagacttacatcggatttcaaaagactccttggaatctgattcagaaagcctcacgcaagagattatgtgccattctgagtttgatgatcgaatccggggcaacggtatggagcccgacagcttagacgaggaggaaagccctcgatggggaagcctacacgagatggaagaggaagcaagtggaaaagcagctcagatggctcgcgagcaaaaccaccatacctgggaccagggcgccaataacaggcaacaaccaatagaagacaaatattcagacctccgctatgacccgaactggaagagtaagaaggaggaagggcagctgctgtctgtggaagcgttgccggagtccacggacagctctttagaaaatctgcctttggctcccctctacccttcccaggagacgtcaatggaactctccgggggaaaaggcgagcagaaagagagtccacagagtgcagcttctttacttggtagtgaatttttaagcccaaactatgagcatggtgcccgtcgcagcaagccgttttcagagctgagcgacagtgacctggaggagaagtcgagcagcctttctccgtacgtgaagagctcaagttcacataacgaggttttcctgccgggatcacgtggccctcggcgaaggaaatccaaacaacattttgtggaaaaaaacaagctcactttgggattacccaccccgaaaacggactcttatcttcaacttcacaataaaaaaagaggggaatctcatccagaacagatctcctaccccgtcagagctacagacaagacgtctattcagaatgccaaggaaatggaaaatgctgccatcgatcctgaagataaatggcatcaaagagcacaacagctaaagaattaccaggaacactggtctcaatatgaaagtacaaaatcaagcaatgtaccaagagggcaaccttctgacatggtgaatgaccatcaaccttccagaagaccagccaagctcaagattcgaaagcagtgtaaacaccagaatggcctgaagtcttccacaacggaagaggtgactgccagtcaggggaaccagaataaccctcccaggcagcaacaaaaccaaaataagcctcttgatacttcaacaaagcctgaatcgattgtgattatgcatgcctctaacaatgatgtacaagcctcaagggcacttagaagccacaatctcaaagaaacctccaatacatttgctccaccaaaacaggcttttgacaaggtcttatctaaaaactctactggatgtgactctgggctgaatgttaataaagaaagaggacacaaagaccaagaagagaaaagattttcatatcagcagctacacaccctttctgacatggatttgaacaaccttaatgaactttctaagagacacgtgctcctgagccagaaaggctctcagtttgtttatcacataaatactcatggatcaaccaaaaataagaaacaactcaaacagccttatacagagacaaaatacaggaacttagaaatgttatggaaattccattcttcttctgacagccagacggttagagcttctccagattcatggctcacccagataatggagcagcatcagcaagccttggtgcagctgaccgacgtgcagcccagtgaaggggccttatccagcgtcacgcttccacctatactgtcaagggtagaaagtgaatcccaactcagttcagagagaagccaaagaaaccaagtgaaaattagccgtagcaattctgaaggctatctgtttcaactggaaaagggaaaaaagcataagaaaagaagcagcagtaagaacaccaagctgaaaggttatcagaaaagagacgtgaagcttggaggcctcggacctgactttgagtccatcagagacaaaacgcaaaaattaatacagcaaaaggaatatgcaaaacaagtcaaggagtacaacatgaagacactatccattctatcaaaaccacaaacagaaaaaactcaaaagaaatctgctatccctcggcagaaggctttggaatacgctaagaccatccccaaacccaaaccatcaaatctgactcatcaagcatcaaaggaacaaaaaaatccaacctatgctgggaaagaagaaagtttacctgaaatctcactgctggaaatactgcagaacagacacgaaagggaaaaacaggctgtggctgctttcaaagtccttcacatcgtatag

SEQ ID NO: 723 - DNA, 2988 bp, Homo sapiens
  CDS (1)..(2484)
atgcgcttggagggagagggccgctcagcgagggcgggacagaatctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggcggctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccctgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcactgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagcttcgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtacctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattaaaaaaaaaaaaaaaa

SEQ ID NO: 724 - DNA, 1486 bp, Homo sapiens
  CDS (117)..(1214)
tttcgtcccaggccgccgcgctgccgcccggcctccccgccagcgcgccaccatgggcagtccccggtttccccttgtaaagatggcggtgagggatcgctgcaacctttagactaatgactgtccgaaacatcgcctccatctgtaatatgggcaccaatgcctctgctctggaaaaagacattggtccagagcagtttccaatcaatgaacactatttcggattggtcaattttggaaacacatgctactgtaactccgtgcttcaggcattgtacttctgccgtccattccgggagaatgtgttggcatacaaggcccagcaaaagaagaaggaaaacttgctgacgtgcctggcggaccttttccacagcattgccacacagaagaagaaggttggcgtcatcccaccaaagaagttcatttcaaggctgagaaaagagaatgatctctttgataactacatgcagcaggatgctcatgaatttttaaattatttgctaaacactattgcggacatccttcaggaggagaagaaacaggaaaaacaaaatggaaaattaaaaaatggcaacatgaacgaacctgcggaaaataataaaccagaactcacctgggtccatgagatttttcagggaacgcttaccaatgaaactcgatgcttgaactgtgaaactgttagtagcaaagatgaagattttcttgacctttctgttgatgtggagcagaatacatccattacccactgtctaagagacttcagcaacacagaaacactgtgtagtgaacaaaaatattattgtgaaacatgctgcagcaaacaagaagcccagaaaaggatgagggtaaaaaagctgcccatggtcttggccctgcacctaaagcggttcaagtacatggagcagctgcgcagatacaccaagctgtcttaccgtgtggtcttccctctggaactccggctcttcaacacctccagtgatgcagtgaacctggaccgcatgtatgacttggttgcggtggtcgttcactgtggcagtggtcctaatcgtgggcattatatcactattgtgaaaagtcacggcttctggcttttgtttgatgatgacattgtagagaaaatagatgctcaagctattgaagaattctatggcctgacgtcagatatatcaaaaaattcagaatctggatatattttattctatcagtcaagagagtaactgaaagacctgcgggactgattcacgtggggagaatgttcacagcactgtcacccggcttctccgcaggctttcctcttccccagtggcccactaatggtatcactccgagtctcaatggtctggctgtgttagactctctccttttgtgtttttacatgcagcactactcttggttttatttcagtctgacatagagttaactgcaatcagattgtagtctgatttatatgaataacggttgctaattttaggactgggtgaaagct

SEQ ID NO: 725 - DNA, 1308 bp, Homo sapiens
  CDS (126)..(1109)
aattcggcacgagggtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtccctaagtgccagctctcccctaaaagttccagctcatctcgcctggcctccccctgagtcagtgggactcccagccactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggcaaaaaaaaaaaaaaaa

SEQ ID NO: 726 - DNA, 5323 bp, Homo sapiens
  CDS (33)..(4523)
cttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcgcctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccggaggtgctttggattttgcatccagctttttctcaacacccccgctggaactcagcggctccatctcttcgccttcggaagcacctgcgtctctgtctctgatgctgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgccatcaggatccttgtttgtttctgaagcaacccccttccctctgcccacagagctgaccgtcgtgggcccatcactcacacccacagaggtgccactgaacacctccacggaagtgagcacaaccagcaccggtgctgccactggtggtcccctcgactccaccctgatgggtgacgccgcaagtcagagccccccagagagtagtgctgctcctcccctgccatccctgcgtcccgtgactgccttcactctcgaagcaacagtcgacacaccaacactggctactgccaagccgccatatgtttgtgatatcacagtccccgatgcctatctgatcacaactgtgctggccagaagagctgtgcaggagtacatcattacagcaatcaaagaagtactgaggattcacttcaaccgtgcagtggaactgaaggtttatgaactatttactgacttcacttttctggtaacatccggtcctttcgtttacacggcaatatccgtcataaatgtgcttataaacagtaagcttgtccgtgaccagactcctttaatcctgtctgtgaaaccttctttccttgtgccagagtccaggttccaagttcaaacagtacttcagtttgtgcctccgagtgtggatactggcttctgcaacttcacccagcgcattgagaaaggcctaatgacagctctctttgaagtgagaaaacaccaccagggaacgtataacctcacggtgcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcccttccagtatccacagctcaacttatctcagttgctgaagtcctcttgggtcagaacagttctcctgggcgtcatggagaagcaactccagaatgaagtgtttcaagccgagatggaacgcaagctggcccagctgctcagcgaggtttccaccagaaggcggatgtggagaagggccactgtagctgcagggaacagtgtggtgcaggtggtaaatgtgtcgaggctggagggagatgacaatcctgtacagctcatctactttgtggaggatcaagatggagaaagactcagtgcagtcaagtcttcggacctgattaacaaaatggacctccagagagcagccatcatcttgggttaccgaattcaaggtgtcattgcccagcctgtcgacagggtgaagaggccgtctccggaatcccagagcaacaacttgtgggtcattgttggcgtggtcatcccagtgctggtggtgatggtgattgttgtcatcctctactggaaactatgccgcacagacaagctagactttcagcctgacactgtggccaacattcagcagcgtcagaagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaagagtttctccctcagatgctgactctacggtcagtgaagagtccagcgagagggacgcaggagataagacgccgggagccgtcaacgatggcaggtcccacagagctccgcagagcgggccaccactgcccagttcgggaaatgagcagcactcatcagcctccatcttcgagcacgtggacaggatctcccgccccccggaggctagccggcgggtccccagtaagatccagcttatcgccatgcagccgatcccggcacctcccgtccagcgcccctccccagccgaccgagtggcggaaagcaataaaatcaacaaagagattcagaccgcgctgcggcacaagtctgagatcgagcaccatcgcaacaagatccgcctgcgcgccaagcgccgcgggcactacgagttcccggtggtagacgacctgtcctcgggcgacactaaggagcgacaccgggtgtaccgcagggcacagatgcagatcgacaagatcctggaccccacggccagcgtgccctccgtgttcatagagcccaggaagagctcacggataaaacgttctcccaagcctcgccggaaacaccaggtcaacggctgtcctgccgacgctgagaaggaccggctcatcaccacagacagcgatggcacctacaggaggccccccggcgtccacaactcagcctacatcggatgcccatcggatcctgacctcccagccgatgtgcagacaccatcctcggtggaactggggaggtatccagcccttcccttcccggcctcccagtacatcccaccccagccgtccatcgaggaggcacgccagaccatgcactccctcctggacgacgcctttgccctcgtggcccccagcagccagcctgccagcaccgcaggtgtaggccccggagtcccacccggcctgcccgcaaacagcaccccttcccaggaagagaggcgagccacccagtgggggtccttctacagcccagcccagacggccaacaatccctgcagtagatacgaagactatggaatgactcccccgacgggtccattgccaagaccaggttttggccccggtttgctgcagtctacagagctggtgccccctgaccctcagcagccacaggcctccgccgaagccccatttgctgccagagggatctactcggaggagatgccgtcggtggcccggcctcggcctgtcgggggtaccacaggctcccagatccagcacctgacacaggtggggattgccagcagaattggagctcagccagtggaaatcccgccaagcagaggcagccagtatggggggccaggctggccttcgtacggggaggacgaagcggggcgaagagaggccgtgccaaggacttcaggcagggagccctcagctccttccgggaacctcccccaccggggactgcagggccctgggctgggttaccccaccagctccacggaagacctccagcctggccactcctcggcctctctcatcaaagcaatccgcgaggagctcctccggctctcccagaaacagagcaccgtgcagaacttccacagctgatcggcctcgcctcgcagatttgccaagtatccgcttcctgtggaagcaagaccaaaaggaaatcaactgagtgggtgtttggaagaggaaggagcaactctcgggcagcctgcccaagggagggagcaagttgcaatttagaagatgccatacgtcgtgtgacagctcatgagcctttcactgggctggcaattgtctgaacacttgggttcagttgaaatatatgtattttggccaaaagccagcagcacttcacaaaaacaaaacacaaacctaagctaacaaaatgactgcattcgtctcttttttaaaggtagagattaaactgtatagacagcatagggatgaaaggaaccaagcgtttctgtgggattgagactggtacgtgtacgatgaacctgctgctttgttttctgagaagaggtttgaagacattttattaacagcttaatttttctcttttactccataggaacttattttaatagtaacattaacaacaagaatactaagactgtttgggaattttaaaaagctactagtgagaaaccaaatgataggttgtagagcctgatgactccaaacaaagccatcacccgcattcttcctccttcttctggtgctacagctccaagggcccttcaccttcatgtctgaaatggaactttggctttttcagtggaagaatatgttgaaggtttcattttgttctagaaaaaaaaaatccctcccaaagtggggcaaaaagctttatatttatttgattatccaaaatacagatcaaagtttagatctac

SEQ ID NO: 727 - DNA, 3462 bp, Homo sapiens
  CDS (146)..(1621)
tttcgtgcaggggccaggcctctctaggctctccggctgagccgggttggggcccgggttgggccgcccggggactctggagcattgggatttgtagcgcgccctctgggtaggcggctgtagcggagaggcgtgcgggatcgggatgtcggggctgctcacggacccggagcagagagcgcaggagccgcggtaccccggcttcgtgctggggctggatgtgggcagttctgtgatccgctgccacgtctatgaccgggcggcgcgggtctgcggctccagcgtgcagaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggtttggagctgacaaggaggaagctaaagaaagttgagacaaagtgaagtggttttcaagccacagaagaaatgtcaggaatatgacaatgagtctggaaaactgggccaaagcagtgaaacgctccatgaattggtataacaaggacataaggactaaatgaaatgatcaaaaccataggtagctggtttatgtgacgtgcagatgagatgaagctcagggataacccatatgacaatgactaagaggagaaaattttaaataagcttcataacttaagaagcattgcttttaaaaaaacaaaacggaacaaaaaactcttatttttttcccctaaaccatggtaaggcagcaatacctcaaaactttatatcttctattttgtagcaaattccaaaggacattagtcatttccaaccacattttgacagttatgggtcctcttcctttttatactgggtcagtggtacataggaacataatgatttaccatccaagctaatagttctgggtcaagtaccatgcacatattgttccaaaattatgtgaaacgtatttctttaattctttaagtgggctatttgaagtacatatagctaaaaagaaagaataactgagaaaatgtggaattttgaaacattaatattttatgtttaaagccataatttcctaatattatatccaaatatgagcttaatatgtccctctcagataagcttatgagatagttaatgctttcctttactggtcttaaagacactgccttaatttttccttgttcaaccaaaatctgagcattctttctatgttgaaaacactgaaaaactaattttagttaatgaactagaaagaatattgatttttaagaaacagaaaaatactacttattttccttctcaaataacgtttctttcaaaaacttctggctgaagtataacatgctggtagttaacataaatcttgtctttctcttgttctttatctttctttgttatttagatgcttgtataaatgtcttttgtttttattaagtgcctaattgacagagcttaatttgaagaagtgccctaatttattgaccacttaagaattgcctttattggggtattttatttgttcctgcgtctttttgatgtttgttcagtctactcatccctgtgagtatgtgtgggggacagctgatagaagggaggagagtgtgtctatgctcaggattgccctttagccactcagccagagatccacagggagcaacaaggacagtttcacatgcttagactttcttggaagaaacagtgaggaggagtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatcaaaatcaaaaaaaaaaaaa

SEQ ID NO: 728 - DNA, 1423 bp, Homo sapiens
  CDS (267)..(872)
aatacagtggggccaaaacaaatggggaaaaagacaaatttagaaaacaaagaaagtagatgctcaactgagccagaaggaagtcactagcaaagaggaaaaaaatagagctctggaaaaatagtgtaaacagtcacaagaaagggaccctgtgtcatgcctgacatctggacaggtatataaagagcccaggctcagggagctccacacctgcacctccctctcacctgctcctctacctgatccaccctcaatctaccagaatcatgggctgctgtggctgctccggaggctgtggctccggctgtgggggttgtggctccggctgtgggggctgtggctctggctgtgggggctatggctctggctgtgggggctgtggctccagctgctgtgtgcccgtctgctgctgcaagcccgtgtgctgctgtgtgccagcctgttcctgctccagctgtggctcctgtgggggctccaagggggactgtggctcttgtgggggctccaaagggggctgtggttcctgtgggggctccaaggggggctgtggctcctgtgggggctccaaggggggctgtggttcttgtgggggctccaaggggggctgtggctcctgtgggggctccaaaggtggctgtggttcctgtgggggctccaaggggggctgtggttcttgtggctgctcccagtgcaattgctgtaagccctgctgctgtccctcaggctgtggatcctgctgccagtccagctgctgcaatccctgctgctgccagtccagctgctgtgtccccgtgtgctgccagtctagctgctgcaagccctgctgctgtcagtccagctgctgtgtccccgtgtgctgccagtgtaagatctgaggctctgaacccagaccttcaggtttcacctgtttggtgaaagcatttgttatgatttccctgaattaattcatcccacgcatcctccctgaggcacctgccccttctccagctcatcatccatgcacgcacctccttccatggctcagctctccactgggccctgccttcagcctcctcactccggaaatgcatgtttccttgatgcaggaggtggccttgcctggacgcgggcacccagccaactgccatggtgttccctgcacttgggtgtggaccatcttcttcttctccctcggctgactgagatgcaaggtctgaccccacaaggccaggccaatgttgtcagtgatcactaagaaccagcttctcaaccaccattgggaccctggatcctccagggccgctcgctgcctgttttccagtggccacctgtgaccaggaaggtctccttccttcctgttgtctccatctatttaaaaacaataacaaagtaatgaatgaatttccttacaataaagcctttcatgtctgtaaaaaaaaaaaaa

SEQ ID NO: 729 - DNA, 1172 bp, Homo sapiens
  CDS (107)..(1078)
gtgccgtgtaattcgccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttgggcttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcaaagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatggcaggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcaaaaaaaaaaaaa

SEQ ID NO: 730 - DNA, 6088 bp, Homo sapiens
  CDS (55)..(3702)
ccgttgtcagtggcattccattgtttgctagaccttgttcgtggaatcacaagtatgattgaaggagagctaggagagcttgaaacagaatgtctaaccaccaatgaagaaggttcttcaccaacacagtcgacagaacagcaggatttacagtcaacatcagaccaaatggataaggaaattgttagtagggctgtttgggaagaaatggtgaatgcctgctggtgtggtcttcttgctgcactctcactccttcttgatgccagcacagatgaagctgccactgagaatattttaaaagctgaactgactatggctgctctttgtggaagactgggccttgtaacttcaagagatgcctttataactgcaatatgcaaaggttccctgcctccccattatgctcttactgtattgaataccaccactgcagctacactttccaacaaatcatattccgttcagggccaaagtgttatgatgataagtccatcaagtgaatctcaccaacaagttgtggcagtgggtcaacctttagcagtccagcctcaagggacagtaatgctgacttccaaaaatatccagtgtatgaggactttacttaacttggcgcattgccatggggctgttcttggaacatcatggcaacttgtcttggcaactcttcagcatcttgtgtggattctgggattaaagcctagtagtggcggtgccttgaaacctgggagagctgtagaaggacccagtacagttctaacaacagcagtgatgacagatttaccagtgatttccaatatactttcaagattgtttgaaagctcacagtatcttgatgatgtatcactgcatcatttaataaatgcactttgctccttgtctctagaagcaatggatatggcctatggaaataataaggaaccatctctttttgctgttgccaaattgttagaaactggtttagttaatatgcaccgaatagaaattctgtggagacctctgactggccatctacttgaggtctgccagcatccaaactctcgaatgagagaatggggagcagaagctttaacttctcttattaaagcaggattaacatttaaccatgatcctccactctcacaaaaccagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgtgtggatccccgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacgttgcaaatgcaaaatataatcagatccaactatttgcaccggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagagatcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcagataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctattcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaa

SEQ ID NO: 731 - DNA, 2745 bp, Homo sapiens
  CDS (117)..(2192)
acattgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatacctctcaagcaacagcttcagtgggatcctagcagtcacagtttgcaggggtttatggactttggtcttggaaaacttgatgctgatgaaacgccacttgcttcaaaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattaggatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattgatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatcaaaatattgactccatttatgactagactacatttctgaaagatctttggtttatgattcttaagaatattgacaatacctataaaactttgaagataacttttacttaaatatgaaaattatagtttgaaaattaggctcaagcaaatatcaaatactgcaaaaatccccttgtcccaggataccctaaaatagaagtgc

SEQ ID NO: 732 - DNA, 2072 bp, Homo sapiens
  CDS (57)..(1445)
tccagagtcccgctgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgaggaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattcgtggaaaaatataaaaacataaattctaagtttgaaatcagttcaaagtttatttatagatatatctttccaacacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatcta

SEQ ID NO: 733 - DNA, 2241 bp, Homo sapiens
  CDS (41)..(1918)
tttcgtggcgggaaggcgccggccgctaagaagccgaaagatgtccaggtcgggcgcggcggctgagaaggcggactccagacagcgaccccagatgaaggtaaatgaatataaagaaaatcaaaacatcgcttatgtgtctctgagaccagcacagactacagttttaataaaaacagctaaggtctatcttgcccccttttcactcagtaattaccagctagaccagcttatgtgccccaaatccctatcagaaaagaattctaacaatgaagtggcgtgtaagaagactaaaataaagaaaacttgcagaaggattatacctccaaagatgaaaaacacatcttccaaggcagaatccacgctgcaaaattcatcctcagctgttcatactgaaagtaacaagctacaacccaagagaacggcagatgcgatgaatctcagtgttgatgtggaaagtagtcaggatggagacagtgatgaagataccacaccatccctggatttttcgggattgtcaccctacgaaaggaagagactgaagaacatatcagaaaacgcagacttttttgcttctcttcagttgtctgagtctgctgcaagactccgtgaaatgatagagaagagacagcctcctaaatccaaaagaaagaagcctaagagagaaaatgggattggatgtagaaggtcaatgcgattactaaaagttgatccttcgggagtttcattaccagcagctccaacaccgccgacattagtagcagatgaaactcctttgttacctcctgggcctttagaaatgacttctgaaaatcaagaagacaacaatgaacgatttaaaggatttctgcacacatgggcaggaatgagcaagccaagtagtaagaacactgagaagggattatctagcattaaaagctacaaagccaatttaaatggcatggtcattagtgaagataccgtttacaaagttaccacaggcccaatattctctatggctctccatccatcagaaactagaactttggtagcagttggggccaaatttgggcaagttggactttgtgatttgacccagcaacctaaagaagatggagtttatgtttttcatccccatagtcagccagttagctggctttacttttcacccgccaatccggcccacatactgtcactgagctatgatggcacgttacgctggggggatttttccagggctatttttgaagaggtgtatagaaatgaaagaagtagcttttcctccttcgacttcttggcagaagatgcctccactttaatagtaggacactgggatggaaatatgtcactggtggatagacggacacctggaacttcttatgagaaacttaccagttcttctatgggaaaaataagaactgttcatgtccacccagtgcatagacagtattttatcactgccggattgagggatactcatatttatgatgcaaggcgattgaattccaggagaagtcagcctttgatttctttgactgaacatacaaagagcattgcttccgcctatttttcacctcttactggtaacagagtggtgaccacatgtgctgattgtaatctgagaatttttgacagcagctgtatatcttctaagattccgctcctcaccaccatcaggcacaacactttcactgggcgatggctgaccaggttccaagccatgtgggatcctaaacaagaagactgtgtcatagttggcagcatggcccatccacgacgggtagaaatcttccatgagacaggaaagagggtgcattcgtttggtggagaataccttgtctctgtgtgttccatcaatgccatgcacccaactcggtatattttggctggaggtaattccagcgggaagatacatgtttttatgaatgaaaaaagctgctgagtttttggtttaggaacatcaatttgttcaaattgaccactgtctaaggagcctagtaatcggcgtgccttagtgtgtttatgtggtaatgtgttacatttagcaattataacattgttttattaataagactataagaagagtgtacttttagtaagggagaagtcttggagggttgcttctgcaggacggggagggaatttgaggggaggctgaggtgccgtcaggacttttttttttttttttttttaaaaggaatttttctttttgtgcccaaggtggaggggaaatacccgatttttgtttccccaaaccttccc

SEQ ID NO: 734 - DNA, 2763 bp, Homo sapiens
  CDS (592)..(1089)
cccaaaagatctaaacgagggttgctcggaggggagaatacaccagacttgatccaccatttgaggaatccggaggaggtgctctctaagaaatgtccatttatttgagatgatgagaacatgctcattacccgtctggagagtcctgtttgccaacacgcgtgtcatgggctgctgaagagacattccagagcagtacatctgctatatctcccgggacccaccaagtcagaggtggagtgcaaaatatcgtttatgataaggagtgttgcaataatgggagaatgtgcgggttatcatttttcaaaagaaaattattctcatctcaatgccaaaaagatagtttctacacatcacctgcttgctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagaaaaaaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatgttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttggggctgtggatttttttaactgctagtaggggaatactggaaaagcttcatttctgaagatgaattttatttttaaaaaatacatgcacactcaaaacttttagctttgatcacaaggggacaaatttctgaaaccaaaggcaactaagttgctgggttagctcttgctggattttgagcctaggtcctactgtctgccagtactcatgtgagttgtatgtgcccccagtgctacatacgcaggtatgcgtaagtgtgtatgcttgttttaaacaaacactcaacgtacatatgtacataatctacacatatttatatcacatatctagttttattactatagactatacgaattggtggttaacatgaaatgttaccttttaacagactgtttttaaaaattaaaaatgtatgtataggttttgaaatttttttaaaaggggagaaagactgttaagaggaggctatttgatgacataacacttgaatattttatgcctcattctgtttatcagttctcgcaatctgtataaatgcattttagaactgatagacagtaaacttgaatttatctttgataagaatacatgccactgtacattcagatattatttaaatttgcaaacacattgttctatatgtaagggtactgtatgtaaaactctgtattaaaactattccacataaaaaaaaaaaa

SEQ ID NO: 735 - DNA, 392 bp, Homo sapiens
  CDS (34)..(351)
gcaagtccttctgtgccgatagcactcacgcaaatggtcaactttcttaaaattcactggactttctttaagaagtgtggcaagcatcacccccccaaagtgacccagtacaagaagggaaaggattctctgtatgcccagggaaagcggcgttatgacaggaagcagagtggctatggtgggcagactaagtcgattttccggaaaaaggctgaaaccccaaagaagactgtgttaaggcttgagtgcgttgagcccaactgcagatttaagagaatgctggctattaaaagatgcaagcattttgaactgggaggagataagaagagaaagggccaagtgatccagttttaagtgtcatcttttgttttattatgaagacaataaaatcc

SEQ ID NO: 736 - DNA, 342 bp, Homo sapiens
  CDS (80)..(220)
ttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtaaaaaaaaaaaaaa

SEQ ID NO: 737 - DNA, 554 bp, Homo sapiens
  CDS (44)..(286)
aggcaagaattcggcacgaggcaaactcactacccctgacaccatgagctactacggcagctactatggaggcctgggctatggctgtggaggctttggtggcctgggctatggctatggctgtggatgtggcagcttccgcagactgggttctggctgtggctatggaggctacggatatggctctggctttggaggctatggatatggctctggcttcggaggctacggatatggctgctaccgcccatcatactatggaggatatggattctctggattctattaaactactgccccagcaacacaatgtgtgaaattataagaggactttcccagagctgacttcaatcattggacaacaaagatcatgctggagctatttgcacaaaagaatttaacatctcagaatttcaggcaattttttttctctgtatacccacatctctataataatcctagtattctctagttttgcttttaaagctgattgaattatctgtttatcttccaataaaacattctattttcaaacacaaaaaaaaaaaaaaaaa

SEQ ID NO: 738 - DNA, 2327 bp, Homo sapiens
  CDS (640)..(1623)
tccactggtcatcattaactttctggagaaaggatgcttctccccaatacttgatcttgaacttaactatggccggttagtctcctatagctcccaccacatatcctctccttggcgaaaaattcaccctacatactctgtcctggaacatctatctgacccctgctcagattaaggaatttggtgcagtttcaaaagtagacttttctcctcagcctccatataattatgctgtcacagcttcctcaagaattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggctcatacaaaagcagttcatacagtagattttacagctgacaaatatcacgtggtctctggggctgatgattatacagttaaattatgggatattccaaactccaaagaaattttgacatttaaagaacactctgattatgtgaggggtggatgtgctagcaaacttaatccggatctctttataacaggatcatatgatcatactgtgaagatgtttgatgcacgaacgagtgagagtgttctctccgttgagcatgggcagccagtggagagtgtcctacttttcccctctggaggtcttctggtgtcagcaggaggtcgttatgttaaagtctgggacatgttaaaaggaggacaattgttagtatctttgaaaaatcatcacaaaaccgtgacatgtttatgtctaagcagctctggacagaggttactctctggctcactggataggaaggtgaaagtatacagcacaacttcctacaaagtagtccacagttttgattatgcagcttcaattttgagtcttgcccttgcacatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggatgacattttgattaacaggccagcaaagaagcacctagaattgtatgacagggatctgaaacattttcggatctctaaggcactcgatagagttcttgatcccacttgtacaataaagacacccgagattacggtgtccatcataaaggagttaaatcgaagaggagtccttgcaaatgcgcttgcaggtcgggatgagaaggaaatcagtcatgttcttaattttttgataaggaatctttctcagccaagatttgcccctgttttaatcaatgctgctgaaataattattgatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctaggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactactttttttttttcttcatgcagcctttctaccaagtttg

SEQ ID NO: 739 - DNA, 808 bp, Homo sapiens
  CDS (572)..(727)
tctgttcaaggggacgcattcaccaagtgtccccgttagccaagttagcctgctgtggccagctctttactttttccccccgaagccccttcagctctgttttctctttcggggtcatgaagtttgtccacggcccctactcctgacagcctctgggatgggtgctgcggaggcagcagcagccacacagaaagaggcagatcagcgttgtcacccctacttttgtaaaaggaaatctggtattgccaggctgtgtggttagcgactcacatatgttctcgaaatctcacaaaagccctgtgaggtagaaattattttacccattttataggaaggaaattgagactgagcgagccggcttcggattggctcaaggtcacatatagtcatcattcgaacctcactcagtctgcttctttctgaagtctgtgcagcttaatcacttcagaatgggaaggaaacgggggcccagggaagttaagcaacttgcccactcactcagtctaattggtgcccggggcagggacagaactcactcaattccactgctttccccagtttctggtgagtgatgtgtgcctggcactgtgtgcacctggcactgtgtgtagtaggaatgctgtttcttctgtctgtaacctcctcccagttctgtacacaaagacaaaaccatgccctgcccttaaagcctatagggtcaaatgccactcttgatgatgcttccctataacacatttgtactctatggattgccgtatgcacggaggtttttttgtcatttgcaccttgtggccctggtcggtttccc

SEQ ID NO: 740 - DNA, 4498 bp, Homo sapiens
  CDS (102)..(2585)
ggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaagtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcaaattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggaaatttccctggacctcaagaaaactagagatgcagcatttaaaatcctgaaccctatgactgtcccaagattttttaggctgaatagcaacaatgccttgatagagttcttgttggagggtactcctgagataagagaacattatcttgactctaaaaaagacgtagaccgtcatctgaaatcggcctgtgagcagtttattcagcagcagaccaagctgtttgtagaacagctggaggagttcatgacaaaggtttcagcgttaaaaacaatggccagtcagggaggccccaagtatactctctcacagcagccttgggcacaaccagcaaaggtcagtgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacagctgagccttctgctgtcagtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaaaaaaaaaaaaaaaaa

SEQ ID NO: 741 - DNA, 1635 bp, Homo sapiens
  CDS (56)..(391)
  misc_feature (1)...(1635): n = a,t,c or g
atgcttacgccaagcttggcacgagggtgggagaaaggtggtgctgaaaggacagatgctagttgtagtttcactcactcattcattcattagtgcaacagtactgagcaccacctgcactagaggcagaggggtgaacaagatacccttctgcctggggggatgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacggcctttccccagccaggagagaccacctaaggatcaaggcagctcctgttttcttggttctgtgacactcgagtctgagccagcccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgagtgccnnaacacaattnnacaaaaaaaaaacgcccagaaagttaaaaaaatctttcctaggggaataaaccccccatttcttatttttaaaccggcccctccaaaaaaaaaacgccctggaaaaaagggacccccccccccaaaaaaccttcctttttcggcccaaccccaacttttaaaggggggcttggggcgccaaataggaggggggggaaaaaaaaaaa

SEQ ID NO: 742 - DNA, 820 bp, Homo sapiens
  CDS (87)..(470)
tttcgtgcaatcgtgtctggggccccagcccaggctggccggagctcctgtttcccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgcccccctgccccacctttcctttccttcctgtgggccctctttcaaagtccagcctagtctggactgcttccccatcagccttcccaaggttctatcctgttccgagcaacttttctaattataaacatcacagaacatcctggaaaaaaaaaaaa

SEQ ID NO: 743 - DNA, 2621 bp, Homo sapiens
  CDS (193)..(2511)
cgggtcgacgacttcgtactaaacaggtgcccaaatgtgagtctgcaaaagctgccagaacagtggctatagactgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgatctctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggattgggatgggggtatgtgtggatttttcctccactaaatctgcaggaaacatgttgaacataaattcaaaaattttatcccaaaaaaaaaaa

SEQ ID NO: 744 - DNA, 1216 bp, Homo sapiens
  CDS (96)..(656)
gcacgagtttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgaatgatgctcgatgattgtgctgcagcttaaaatgatgtggaatcaaagaaggtacaggggtggagccctccgaggattctcagcctggtagcctggttgttgcattcaagaagacctttctcttacgctgggtttggaatgcaacccaaaaaagtaccacaattccaagatggcccttttgaatgttcgagcctcgcagtgcaagctgggaagagcacgtcgcgagtcaaagggccccacaggcgggggagtatccacggggcagggtgatgccccggggcggacatccttctctgaaaaaggtggagcaagagacacgcctctggtggcccacatgggttggtttgcacaacccactaggggatggtggcccacacggaatatgtacgggagaacaatcatgacggccgacacacgcgagggagtcatgaacgacaagcgggttgaggaacacacacaggagccgtcggctgacggagcgcgaggacgaacagagaggcagtagtgtccggaacaacccacgtgcccagaccgtcgcatggtcccgtcagcacggtgagccacccatcct

SEQ ID NO: 745 - DNA, 1042 bp, Homo sapiens
  CDS (104)..(652)
tcagcaccgacccaaacaagcaggaaacaggaaatgttcacgtttcagagaggctgcagcccggggcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgaaggtggagaaggaggccggtgaagttcttacttttgatcaacatgggttggccttctttagccaattttaacttaatgcccttacttctggcaagaaaaagttcggaacctttttggttatttctttggggcctaattaggaactggt

SEQ ID NO: 746 - DNA, 2564 bp, Homo sapiens
  CDS (432)..(2561)
ctcttgaattcatttgctaattgtatgtgtgtgtgtttctgtgggtttctttaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatga

SEQ ID NO: 747 - DNA, 537 bp, Homo sapiens
  CDS (142)..(345)
tttcgtctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatggtgagtttgccatttgctttgcttgtagtgtttattgcacggtttgggaaataggtggaatgttaagcctcaggaagagcgtgaagaggaggttctggtttgaagtttgagaagggggctgacggatttgcacctggaaaacgacttgaaagacaattgggatgtttgtaaatccggagcttctagatccaccgttggagagagtacactactaaatttttctgggaaagcctacaataagtccttttggctgagtgtgagagtgggacgtttaaaatacgaaaagagtgaatgcttag

SEQ ID NO: 748 - DNA, 3342 bp, Homo sapiens
  CDS (227)..(1696)
tttcgtgtctggccggagcccttgggtgaaattgttaggcgtggagagggagtgatgtcttccagactcggtgctgtacccgcctagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttaaaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgtacctcatgcctatctggtaatgtttaatgggttatttctctttgagggtggctttctctggaacattcgttagagcagctttgttgtcgtgtttctggattctcttccccattttgcgtaaatattggtcttatatattcttgcctattttgtggcatatgccacataaaaaatgaacctgatatagacaagtactaccttttcaaattctgaaaggctattaccactttaactctttgtgctcctccaaatagctttaaaatgtgggcttttgtgaagaccactttcaaacaagggagcactgaaacctgaattggatactgccagaataggtagttttgaaacaagttaaggacatggtatatgcactctgcattttcattggcagtgtgcccttaaagccctttcagtagatgagggttgtcagggaggagaaatgaagaagctatgttaatttctggtgagtaagacctggggaatgtttggcaatgacaaaagaaataaatgactctcagaaaaaaaaaaaaa

SEQ ID NO: 749 - DNA, 1867 bp, Homo sapiens
  CDS (1103)..(1675)
tgtcgttgttctgagggcagaatttcccttctaacaaaaagcagcctccaaaatcatttcttttctaacaaaaagcagcctgaaaaatagagcttgaaacatagagataagccagctggaagcctgcacaggggaacgctggcagccgtgccagtagaaaagggccagacatgtcccacacggaggctccatcctcccttttttggttaccacatgtacagtaataaagaaatgggcaacacgctgttcttcttgttatccttccgtggctactgtaaagcatttagagacagtaacaaggagggagcacgttcttccacctgggcaacacgctgttcttcttgttatccttccgtggctactgtaaagcatttagggacagtaacaaggagggagcacgttcttccacctgggcaacacgctgctcttcttgttatccttccgtggctactgtaaagcatttagggacagtaacaaggaaggagcacgttcttccacctgggcaacacggtgttcttcttgttatccttccatggctactgtaaagcatttagggacagtaacaaggagggagcacgttcttccacctgggcaacacgctgttcttcttgttatccttccgtggctactgtaaagcatttagggacagtaacaaggagggagcacgttcttccacctgggcaacacgctgttcttcttgttatccttccctggctactgtaaagcatttagagagagtaacaaggagggagcacgttcttccacctgggcaacacgctgttcttcttgctatccttccgtggctattgtaaagcatttagagacagtaacaaggagggagcacgttcttccacctgggcaacacgctgttcttcttgctatccttccgtggctattgtaaagcatttagagacagtaacaaggaggcagcacgttcttccaccttctgggtgctgctgagcatctttctgggagcagtggccatgctgtgcaaagagaaagggatcaccgtgctgggttggaacgcggtgtttgacatcttggtgagaggcaaattcaatgttctggaaattgtccagaaggtaccacataaggacaagtcatgagagaatcttggcatgctcaggaaccgggactcctcttcagaatgaccctgctcgcctccggaggggctgggatgctctccgtgcgctggaggatcataggcccgggcccgccggccttcaccgaggaggacaactgggcctcctttgctgaccgcgtgctggcgagggccataaacgacaattactcctattcattgaatgcctggctgctgctgctgcgtccctggtggctgtgttttgattggtcagtgggctgcagccccctcatgaagtccctcagcgacgggagggtaactgcatttgcagcgctctggttccgcccaattggcctaatacgccaagccctgtgctctgcagacggccaccagagaaggatccttactctgcgcctgggattgctcgttatcccgtttctccccgcaagtaacctgttcttccgagtgggcttcgtggtcccgagcgtggggtgctgtgtgatgctgctttttggattcggagcctgcgcaaacacaccgagaaaaagaagctcatcgctgccgtggtgctgggaatcctactcagcaagatgctgagaggctgagatgcgcggtgcgcggcggcgagtggcggagcgaggggcggttttcagaggcgctgtgtctgtgtgtcccctcagtgctgaggttcgctgcaacatcggcagaaacttggctgctaaaggcaaccagacgggcgccatcagataccaccgggaagctgtaagcttaaatcccaggacgaaa

SEQ ID NO: 750 - DNA, 669 bp, Homo sapiens
  CDS (55)..(480)
tttcgtcagagccgcgggaggacggttgcctggtactattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggtgaatggtttcttttttgtttacaaaactattctgcgtaaaaaaaattcaagcaatgtagaaataagtcaaattaaaaagtgaaagtacccactcccactctccagggataatctctgttaaaataaactaaaaataaatctcattttgaaacatataatatgacataatattcttttaaatttgaacaaagaatctatattgtacttagaaaaaagtagatcaaaccatagagtgtttaggagggagactatatcatgctgaattaag

SEQ ID NO: 751 - DNA, 930 bp, Homo sapiens
  CDS (135)..(644)
tttcgtgccctaagctcggcgttccagagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaacaaaaaaaaaaaa

SEQ ID NO: 752 - DNA, 3228 bp, Homo sapiens
  CDS (108)..(2882)
tttcgtggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagcaacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgcaaaactggttgaacagcagatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttttggaaaagtaaagaaaaaccctttttatggctcacacagcttaagagtagctgtctctcaaacgtgcgctcacagttgagctgcttttgttttattctaaataaattgtttcttttgaggaaaatgttaaacaaaaaaaaaaaa

SEQ ID NO: 753 - DNA, 2153 bp, Homo sapiens
  CDS (698)..(2002)
gctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggagtgcggcggcacctcctttgaggaggacctggactctgtggctccgcgatccgccccagctggggcctcggagccgcctccgccgggaggggtcggtctggggatccgcaccgtgaggctctttggggaggccgggcccagcgtcgggagtcggcagcagcggcggctggcggcagcggcagcggtacgggcggaggggacgcggcgctggatttcaagttggcggctgccgtgctgaggaccgggggtggaggtggtgcctctggcagtgacgaggacgaagtgtccgaggttgaatcatttattttggaccaagaagatctggataacccagtgcttaaaacaacatcagagatattcttatcaagtactgcagaaggagcagacttacgcactgtggatccagagacacaggcacgactagaagcattgctagaagcagcaggaattggcaaattgtcaactgctgatggtaaagcttttgcagatcctgaggtactccggagactgacatcctcagttagttgtgcactggatgaagctgctgctgcactgacacggatgaaagcagaaaacagccacaatgcaggacaagtggacactcgcagtctagcagaagcttgttcagatggggatgttaatgctgttcgtaaattgctagatgaaggcagaagtgtaaatgaacatacagaagaaggagaaagcctgctgtgtttggcttgttcagcagggtattatgaattagcacaagtattgcttgctatgcatgctaatgttgaagatcgagggaataaaggagacataactcccctgatggcagcttccagtggaggttacttagatattgtgaaattattacttcttcatgatgctgatgtcaactcccagtctgcaacaggaaacactgcgctaacttatgcatgtgctggaggatttgttgacattgttaaagtgctccttaatgaaggtgcaaatatagaagatcataatgaaaatggacatactcccttaatggaagcagccagtgcaggtcatgtggaagttgcaagagttcttttagatcatggtgcaggcatcaacactcattctaatgaattcaaagaaagtgctctaacacttgcttgctacaaaggccatttggatatggttcgctttctacttgaagctggtgcagatcaagagcacaaaacagatgagatgcacactgccttaatggaggcctgcatggatggacatgtagaggtggcacgtttgcttttggatagtggtgctcaagtgaacatgcctgcagattcatttgaatctccattgacgctagctgcctgtggaggacatgttgaattggcagctctacttattgaaaggggagcaaatcttgaagaagttaatgatgaaggatacactcccttgatggaagctgcccgggaaggacatgaagaaatggtggcactactcttagcacaaggagcaaatataaatgcccagacagaagaaactcaagaaactgctcttactttggcttgctgtggaggattttctgaagttgcagactttcttattaaggcaggggctgatatagaacttggctgctccacacctctgatggaggcatctcaggagggacacctggaattggttaaatatttgctggcttctggcgctaatgtgcatgctacaacagcaacaggagacacagccttaacctatgcttgtgaaaatggacatacggatgttgcagatgttttacttcaagcaggggctgatttagacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtaaaaaaaaaaaa

SEQ ID NO: 754 - DNA, 2520 bp, Homo sapiens
  CDS (1)..(2373)
atgtggttctttgcccgggacccggtccgggactttccgttcgagctcatcccggagcccccagagggcggcctgcccgggccctgggccctgcaccgcggccgcaagaaggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccagggcaacggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgcctcctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcaggtcagcaactccgaccacaaatcctccaaatccccagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacacccaaa

SEQ ID NO: 755 - DNA, 758 bp, Homo sapiens
  CDS (183)..(755)
acacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaagggcgctggggagctgcagcaggagtgtgagcagtgaagaagtaggggcagctctgggtgtagaaagaaccctctggggtcgtgtcaaagatggaccagagggagagtctggaggccgggagaagctggccaaatataacacatcccagggatggatttgggtcataggccaccagctggggtctccagttcaagttggatcctggaattcattgtacaaatacttactgagcacttctaagactgagggccctctccaggatccagaggacacagtgctacagaagaacatgtttatttacttacgagacagacataagtga

SEQ ID NO: 756 - DNA, 1860 bp, Homo sapiens
  CDS (1)..(1857)
atgccttctcaaataggagacaggaagtggcttcatggattacaggcagccctccagaactttctcaagggatatcctgcaattgttcggcaactgcactcagcaggcagaggcaaaagtgacaccagtcaaaagaaacccaaagaacttctggagtcccttctccaagctgacattgttaaatttgcccacttcttgttggatgtcatgaatgtccttagcattctgtcctgtgtcaataagaatagaaattcctcaattgctgacatatttgccactttagagtcaatgctggaaatgctccaaatgtatcaaacaagactagggccaaaagaacgcatggtggattcagccacacactttcatggtaactgcctcagagggaaagaaaacatttctgctgtgagaaacattgttttaacacatcttatcaagagacttcaaggctgtttcagagatgccagccaaaatgtggtgagggctaccgtgattggaagttttaaattgtggcccacaaagataaatcaagaatttggagaaaaagaggtatccatcctgactgcacattatgaaccagtattagaagctgccaatgtgaaacttagtgaagtggatactgaatggagcatgttgaaattagagatttatgccagatttcagaacattcgaaaattgacctgggattttgtgaattccatttacttacacaagtatccaaatatcctgacactagtcgacctagtgttgacccttcctgcaagttcagctgaagcagaacatggctttagtcagatgaaatggaccaagtcacatatgcatgcaaaaatcaaggctgaaagcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaaggcgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatga

SEQ ID NO: 757 - DNA, 2068 bp, Homo sapiens
  CDS (215)..(1273)
atggttggtgagagccaggggtccacacagacagttactttggagttccttgaatgggagcaacttgtctttggccaggacagaagacacaggtggctgcggaagagtgaaaggatgccagactatggaactttatcaaaatctacaccagagaatttgttattattaaggaatgatagaaaatggtttttcattggtggaatgagtggtaaagatgggctggaggtttggaagatgccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaacccctccaaagtgaaggctcccatcctacacacagatatttgcttactgtgtgggccgatagctgtgaactatgtaaggttttttaaacaatagtttaaatttttaggctttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaaaaaaaaaa

SEQ ID NO: 758 - DNA, 2192 bp, Homo sapiens
  CDS (31)..(1932)
ctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggccctggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaaaaaaaaa

SEQ ID NO: 759 - DNA, 866 bp, Homo sapiens
  CDS (153)..(599)
taccttcatcttataagcattagaacatatttcaaaacatatgaggatatatcaaaacatctgaagatatatctggtatttgcccaacagagataattgattctgcaatgtgtgccaaattatatgaaacattcttttaacatctaaaaataatgtttggtatttcctcagatatattttcatttctgctgctagctgccttgggcctcacaattttcattctgttttctgactttcaagttatataccgtggaatggagttgatcccaaccataacatcgtggagggttttaattttggtggtagccctcacccaattctgtgtggctttctttgtagaggattccatccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgcatagcaaaaaaaaaaaa

SEQ ID NO: 760 - DNA, 1969 bp, Homo sapiens
  CDS (251)..(1966)
aggcctgccccccccggagcccgaacccacgtgcagctactgcgccttcattgatctgcttcgcggtccaggtggcggctgggtggggcctgggcgggacggggcggggacaaggcgggacgaggcggggcccgatgggtcaaatggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactga

SEQ ID NO: 761 - DNA, 1486 bp, Homo sapiens
  CDS (164)..(1483)
tgtcgttgttctgaggctgtcgttgttctgaggcagttactcgcacaaccccagttaagctgcgctccgggagatacatccagaaagtgcccagaagaaacttcctgctgaaaaaaatgaaaaagcagtatttataacattagaatctggataatttgttaacatggcagaaaataatgaaaatattagtaaaaatgtagatgtaaggcccaaaactagtcggagcagaagtgccgacagaaaagacggttatgtgtggagtggaaagaagttatcttggtcaaaaaagagtgagagttattcagatgctgagacagtgaatggtatagagaaaaccgaagtgtctttaaggaaccaagaaaggaagcacagctgttcatccattgagttggacttagatcattcctgtgggcatcgatttttaggccgatctcttaaacagaaactgcaagatgccgtggggcagtgttttccaataaagaattgtagtagtcggcactcttcagggcttccgtctaaaaggaaaattcatatcagtgaactcatgttagataagtgtcctttcccacctcgatcagatttagcctttaggtggcattttattaaacgacacactgctcctataaattccaaatcagatgaatgggtaagcacagacttgtctcagactgaattgagggatggtcagctaaaacgaagaaatatggaagaaaatataaactgtttctcacataccaatgttcagccctgtgtcataaccaccgacaatgctttgtgtagagaaggtcctatgactggctctgtgatgaacctggtttcaaataacagtatagaagatagtgatatggattccgatgatgaaattctaacactttgcacaagttccagaaaaagaaacaaacccaaatgggatttggatgatgaaatcctgcagttggaaacacctcctaaataccacacgcagattgattatgtccactgtcttgtaccagacctccttcagatcaataacaacccatgttactggggagtgatggataaatacgcagccgaagcactactggaaggaaaaccagagggtacctttttacttcgagactcagcacaggaagactatttattctctgttagttttagacgctatagtcgttctcttcatgctagaattgaacagtggaatcacaactttagctttgatgcacatgacccctgtgtcttccattctcctgacattactgggctcctagaacattataaggacccaagcgcctgtatgttctttgaaccacttctatccactcccttaattcggactttccctttttccctgcagcatatatgcagaacagttatttgtaactgtacaacttatgatggcatcgatgcccttccaattccttcttctatgaaattatatctgaaggaatatcattataaatcaaaagttagagtactcaggattgatgcaccagaacagcaatgctag

SEQ ID NO: 762 - DNA, 1819 bp, Homo sapiens
  CDS (210)..(1289)
aggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcaacttaaatgtatgttaattgaaatgaaatacaatgaaaatgcagtgctcagtccaaaaaaaaaaa

SEQ ID NO: 763 - DNA, 1183 bp, Homo sapiens
  CDS (1)..(996)
atggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcaaaaaaaaaaaaa

SEQ ID NO: 764 - DNA, 1216 bp, Homo sapiens
  CDS (11)..(934)
cgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccaaaaatcgttacagttggagaggatggtcgaataaatctcttcacagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggtaaaactttttaatgaatactgttatgtgtacttttttttttttttttaaaaaaaaagtttaattttatcccccaggtgggagggaaggggcccaatctgggttcgttgaaccctccccctctggggttaaagaaattttgggccccaacccccccaaaaaccgggaattgttatttttccccccccggccccggtggatttttttgatttttaagggaaaagggggttcacccgggtggcccggccgggcctaaacctccggactcaaaagaacccccctccctggccccc

SEQ ID NO: 765 - DNA, 1897 bp, Homo sapiens
  CDS (308)..(1819)
acttatagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgacatttgcagctcagaacgaaaatttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctac

SEQ ID NO: 766 - DNA, 1244 bp, Homo sapiens
  CDS (40)..(696)
ggagcgagctggcggcgccgtcgggcgccgggccgggccatggagctgtggccgtgtctggccgcggcgctgctgttgctgctgctgctggtgcagctgagccgcgcggccgagttctacgccaaggtcgccctgtactgcgcgctgtgcttcacggtgtccgccgtggcctcgctcgtctgcctgctgtgccacggcggccggacggtggagaacatgagcatcatcggctggttcgtgcgaagcttcaagtacttttacgggctccgcttcgaggtgcgggacccgcgcaggctgcaggaggcccgtccctgtgtcatcgtctccaaccaccagagcatcctggacatgatgggcctcatggaggtccttccggagcgctgcgtgcagatcgccaagcgggagctgctcttcctggggcccgtgggcctcatcatgtacctcgggggcgtcttcttcatcaaccggcagcgctctagcactgccatgacagtgatggccgacctgggcgagcgcatggtcagggagaagtgcccatcgtccccgtggtgtactcttccttctcctccttctacaacaccaagaagaagttcttcacttcaggaacagtcacagtgcaggtgctggaagccatccccaccagcggcctcactgcggcggacgtccctgcgctcgtggacacctgccaccgggccatgaggaccaccttcctccacatctccaagaccccccaggagaacggggccactgcggggtctggcgtgcagccggcccagtagcccagaccacggcagggcatgacctggggagggcaggtggaagccgatggctggaggatgggcagaggggactcctcccacggcacctctgggagctgggatgataaagatgaggcttgcggctgtggcccgctggtgggctgagccacaaggcccccgatggcccaggagcagatgggaggaccccgaggccagacgcacactgtccgagccctctgctcagccgcctgggacccaccagggtgcagctgggctccagggtccagcccacaagctgcatcaggctctctgggagaggaggggcctggagggccaggagtcccagactcacgcaccctgggccacagggagccgggaatcggggcctgctgctcctgctggcctggaagactctgtggggtcagcactgtactccgttgctgtttttttataaacacactcttggaagtggcaaaaaaaaaaaaa

SEQ ID NO: 767 - DNA, 614 bp, Homo sapiens
  CDS (1)..(369)
  misc_feature (1)...(614): n = a,t,c or g
atgtcctgcatgtgggtctggctgttcctgctggcactgccctcttctctctcccctcctttcccactctgccctgcttgcccgtcagggtctccggatgcccctgctggaggcagagaagcgttctgtttttatcatcgtccctgtcttggtcctgtccgtgctccccatgtgctcccaatcagttgtcttcgttcctcaacatcagggaaagaaaaaacagcaacacttctccctgtcatcagctctgctgtctccttgtcaggccttgggacgttctctgggctcagtctagggtcgtgcctcatgcctcatgcctctctgggaaggttcccaggggcgccgcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttanctgctgtggcaatggggtggggggtgagtcctaatcagaaggtgggagaagagaataacaaaatggaactccgccccctgccgccacatttc

SEQ ID NO: 768 - DNA, 305 bp, Homo sapiens
  CDS (2)..(289)
catgaagatcccggtccttcctgccgtggtgctcctctccctcctggtgctccactctgcccagggagccaccctgggtggtcctgaggaagaaagcaccattgagaattatgcgtcacgacccgaggcctttaacaccccgttcctgaacatcgacaaattgcgatctgtgagtacgcttctctggtgctacccccacgaataccctcatcacagaggggataaacgccttggtagagagcttgcaaagctgccacggttccttcaccttctccagagggctgggggctaagctctggcctccc

SEQ ID NO: 769 - DNA, 761 bp, Homo sapiens
  CDS (53)..(601)
ggagtggcctaccggggaccctcccccagagggaccggcccggggcggggagatgaacggcttcagcacggaggaggacagccgcgaagggccccccgccgccccagctgccgccgccccgggctacggccagagctgctgcctcatcgaggacggcgagcgctgcgtccggcccgcgggcaacgcctccttcagcaagagggtccagaagagcatctcgcagaagaaactcaagctggacatcgacaagagcgtaaggcacctatatatctgtgattttcacaaaaatttcatccagagtgtccgaaataaaaggaagaggaagacaagtgacgatggcggagattctcccgagcacgacactgacattcctgaggttgatctgttccagctgcaggtgaacaccctacgacgttataaacgacactacaagttgcagaccagaccaggcttcaataaggcccagttagcagaaactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctca

SEQ ID NO: 770 - DNA, 404 bp, Homo sapiens
  CDS (17)..(325)
gttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgtctttttcagacagtttctacctgtatcacccacggtgcagtttgatgtagtagtgccagctttttccttaagtgaactgcccagcaaggctgaccgcactgaggtagttcaaaccttatggcgtac

SEQ ID NO: 771 - DNA, 2590 bp, Homo sapiens
  CDS (190)..(2223)
tttcgtgcacagcggcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcagaatggagcttcggtcctaccaatgggaggtgatcatgcctgccctggagggcaagaatatcatcatctggctgcccacgggtgccgggaagacccgggcggctgcttatgtggccaagcggcacctagagactgtggatggagccaaggtggttgtattggtcaacagggtgcacctggtgacccagcatggtgaagagttcaggcgcatgctggatggacgctggaccgtgacaaccctgagtggggacatgggaccacgtgctggctttggccacctggcccggtgccatgacctgctcatctgcacagcagagcttctgcagatggcactgaccagccccgaggaggaggagcacgtggagctcactgtcttctccctgatcgtggtggatgagtgccaccacacgcacaaggacaccgtctacaacgtcatcatgagccagtacctagaacttaaactccagagggcacagccgctaccccaggtgctgggtctcacagcctccccaggcactggcggggcctccaaactcgatggggccatcaaccacgtcctgcagctctgtgccaacttggacacgtggtgcatcatgtcaccccagaactgctgcccccagctgcaggagcacagccaacagccttgcaaacagtacaacctctgccacaggcgcagccaggatccgtttggggacttgctgaagaagctcatggaccaaatccatgaccacctggagatgcctgagttgagccggaaatttgggacgcaaatgtatgagcagcaggtggtgaagctgagtgaggctgcggctttggctgggcttcaggagcaacgggtgtatgcgcttcacctgaggcgctacaatgacgcgctgctcatccatgacaccgtccgcgccgtggatgccttggctgcgctgcaggatttctatcacagggagcacgtcactaaaacccagatcctgtgtgccgagcgccggctgctggccctgttcgatgaccgcaagaatgagctggcccacttggcaactcatggcccagagaatccaaaactggagatgctggaaaagatcctgcaaaggcagttcagtagctctaacagccctcggggtatcatcttcacccgcacccgccaaagcgcacactccctcctgctctggctccagcagcagcagggcctgcagactgtggacatccgggcccagctactgattggggctgggaacagcagccagagcacccacatgacccagagggaccagcaagaagtgatccagaagttccaagatggaaccctgaaccttctggtggccacgagtgtggcggaggaggggctggacatcccacattgcaatgtggtggtgcgttatgggctcttgaccaatgaaatctccatggtccaggccaggggccgtgcccgggccgatcagagtgtatacgcgtttgtagcaactgaaggtagccgggagctgaagcgggagctgatcaacgaggcgctggagacgctgatggagcaggcagtggctgctgtgcagaaaatggaccaggccgagtaccaggccaagatccgggatctgcagcaggcagccttgaccaagcgggcggcccaggcagcccagcgggagaaccagcggcagcagttcccagtggagcacgtgcagctactctgcatcaactgcatggtggctgtgggccatggcagcgacctgcggaaggtggagggcacccaccatgtcaatgtgaaccccaacttctcgaactactataatgtctccagggatcctgtggtcatcaacaaagtcttcaaggactggaagcctgggggtgtcatcagctgcaggaactgtggggaggtctggggtctgcagatgatctacaagtcagtgaagctgccagtgctcaaagtccgcagcatgctgctggagacccctcaggggcggatccaggccaaaaagtggtcccgcgtgcccttctccgtgcctgactttgacttcctgcagcattgtgccgagaacttgtcggacctctccctggactgaccacctcattgctgcagtgcccggtttgggctgtagggggcgggagagtctgcagcagactccaggcccctccttcctgaatcatcagctgtgggcatcaggcccaccagccacacaggagtcctgggcaccctggcttaggctcccgcaatgggaaaacaaccggagggccagagcttagtccagacctaccttgtacgcacatagacattttcatatgcactggatggagttagggaaactgaggcaaaagaatttgccatactgtactcagaatcacgacattccttccctaccaaggccacttctattttttgaggctcctcataaaaataaatgaaaaaatgggataaaaaaaaaaaaa

SEQ ID NO: 772 - DNA, 2036 bp, Homo sapiens
  CDS (1)..(1890)
  misc_feature (1)...(2036): n = a,t,c or g
atggatgtccaaggtgatgcccagaaaaaggccttgggcaatgacaggaaggtgctagaagctgcactgtgccagctggcattgaagaggtcagaaccaaagcttgacctcatggacctcgtaggggaagacagaaagtggatgatggcgaggaagctgatgcaggtgaacgacactctgacttccgaagatgccggactccggaacagcaagaactgcaccgaaccagccctgcatgaattccccaatgacatcttcacaaacgaggatagaagacaaggtgcgggggccctccatgtgctctgtgccatatacatgttctatgcgctggccattgtgtgtgatgacttcttcgtcccttccttggaaaagatctgtgagcgcctgcacctcagtgaaaatgtggctggggccacattcatggcagcggaaagttcggccccagagctgttcacatcggtcataggggtcttcatcaccaaaggcgatgtgggagttggcaccatcgtgggctcagcggtattcaacatcctgtgcatcattggtgtctgtgggctctttgctgggcaggttgtggctctttcctcctggtgcctactgagggattctatctactacacgctgtctgtgatcgcgctcatcgtgtttatttatgatgaaaaagtttcctggtgggagtctttagtccttgtgctgatgtatcttatctacattgtcatcatgaaatataacgcttgcatacatcagtgctttgagaggaggacaaaaggtgccgggaacatggtcaacggattggccaacaatgctgaaattgatgacagcagcaactgcgacgcaactgtggtgctacttaagaaagcaaatttccaccgcaaagcatcagtgatcatggtagacgagctgctgtcagcctacccacaccagctttccttctctgaggctggccttcgaatcatgataaccagccactttccccccaagacccggctctccatggccagtcgcatgttgatcaatgagagacaaagattgataaacagcagggcttataccaacggggaatctgaggtggccatcaaaatcccaattaagcacaccgtggagaatgggacagggcccagcagtgccccagacaggggcgtgaatgggacacggagggacgatgttgtggctgaggctggcaacgaaacagagaatgaaaatgaggacaatgagaatgatgaggaggaagaggaggacgaggatgatgatgaaggaccgtacacaccattcgacaccccctcgggtaaactggaaacagtgaaatgggcgttcacctggccgctgagtttcgtcttatacttcactgtacccaactgcaacaagccgcgctgggagaaatggttcatggtgacgtttgcttcctccacgctgtggatcgcagccttctcctacatgatggtgtggatggtcacaatcattggttacaccctggggattcctgacgtcatcatggggatcaccttcctggctgctgggaccagcgtgcctgactgcatggccagcctcattgtggccagacaagggatgggggacatggctgtgtccaactccattgggagcaacgtgtttgacatcctgattggcctcggtctcccctgggctctgcagaccctggctgtggattacggatcctacatccggctgaatagcagggggctgatctactccgtaggcttgctcctggcctctgtttttgtcacggtgttcggcgtccacctgaacaagtggcagctggacaagaagctgggctgtgggtgcctcctcctgtatggtgtgttcctgtgcttctccatcatgactgagttcaacgtgttcacctttgtgaacctgcccatgtgcggggaccactgagccgccgggtgcccanagaggctcagctccttcttttctgtgcaatacgagacccggccgcaccccgagtcaaacaggcccccggggccacggcgttcgtctctcctgtgctgtcctcaggcctccgctcctgttttggtggc

SEQ ID NO: 773 - DNA, 1520 bp, Homo sapiens
  CDS (37)..(1371)
agcgagttgccgagcgcgccccgtccctcgcgcgcgatgctcccctggacggcgctcggcctggccctgagcttgcggctggcgctggcgcggagcggcgcggagcgcggtccaccagcatcagccccccgaggggacctgatgttcctgctggacagctcagccagcgtctctcactacgagttctcccgggttcgggagtttgtggggcagctggtggctccactgcccctgggcaccggggccctgcgtgccagtctggtgcacgtgggcagtcggccatacaccgagttccccttcggccagcacagctcgggtgaggctgcccaggatgcggtgcgtgcttctgcccagcgcatgggtgacacccacactggcctggcgctggtctatgccaaggaacagctgtttgctgaagcatcaggtgcccggccaggggtgcccaaagtgctggtgtgggtgacagatggcggctccagcgaccctgtgggcccccccatgcaggagctcaaggacctgggcgtcaccgtgttcattgtcagcaccggccgaggcaacttcctggagctgtcagccgctgcctcagcccctgccgagaagcacctgcactttgtggacgtggatgacctgcacatcattgtccaagagctgaggggctccattctcgacgcgatgcggccgcagcagctccatgccacggagatcacgtccagcggcttccgcctggcctggccacccctgctgaccgcagactcgggctactatgtgctggagctggtgcccagcgcccagccgggggctgcaagacgccagcagctgccagggaacgccacggactggatctgggccggcctcgacccggacacggactacgacgtggcgctagtgcctgagtccaacgtgcgcctcctgaggccccagatcctgcgggtgcgcacgcggcccggtgaggcagggccgggggcttcgggcccggagtcgggggctgggccggcccccacgcagctcgccgccctccccgccccagaggaggccgggccagagcgcatcgtcatctcccacgcccggccgcgcagcctccgcgtgagttgggccccagcgctgggctcagccgcggcgctcggctaccacgtgcagttcgggccgctgcggggcggggaggcgcagcgggtggaggtgcccgcgggccgcaactgcaccacgctgcagggcctggcgccgggcaccgcctacctggtgaccgtgaccgccgccttccgctcgggccgcgagagcgcgctgtccgccaaggcctgcacgcccgacggcccgcgcccgcgcccacgccccgtgccccgcgccccgaccccggggaccgccagccgtgagccgtaagccggcgtccccgcccagccgagagggccggcgcctacctgagggcccctgtgtcccgaacccggagcggaggcgcccaacccggcagacgggtgcaggcccggcctttccccacgcggactccgcgcgaccccggccctctccct

SEQ ID NO: 774 - DNA, 2816 bp, Homo sapiens
  CDS (90)..(617)
atatcgtcgacccacgcgtccgaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccgggtcaccctgcccgccggccccgacatcctgcggacctactcgggcgccttcgtctgcctggagattctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcaatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataaaaaaaaaaaaa

SEQ ID NO: 775 - DNA, 1194 bp, Homo sapiens
  CDS (130)..(966)
gcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccagaagcatcagatggtgaaggagaaggagacacagaagtgatgcagcaggagacagttccagttcctgtaccttcagagaaaaccaaacagcctaaagaatgttttttgatacaaccaaaggaaagaaaagagaataccaccaagaccaggaaaagaagaaagaagaaaattactgatgttcttgcaaaatcagaaccaaaaccagggttacctgaagacctacagaagctgatgaaggactattatagcagcagacgcttggtgattgaattagaagaactgaacctgccagactcctgtttcctcaaggccaatgatttgactcacagtctttcctcatacctaaaagaaatttgtcctaagtgggtaaaacttaggaagaaccacagtgagaagaaatcggtcctgatgctgatcatctgcagctcggccgtccgagccctggagctcattaggtcgatgacagcattcagaggagacggcaaagttataaaattatttgcaaagcacataaaggtccaggcgcaggtaaagttgctggagaagcgtgtggtgcacctgggtgtaggaactccggggagaattaaagaacttgttaaacaaggtggccttaatttgagccccttaaaatttctggtttttgactggaactggagagatcagaagttgaggagaatgatggacattcccgagataagaaaggaggtattcgaacttctggaaatgggagtgctcagtctgtgcaagtcagaatccttgaaactgggccttttctaagtctgtgtcctaatgaagattccagttttcacagtagaagttgcatcttatttaatgactctgatacattgcaagcactcagtaaatatcagcaaatagtttatgttaattgtgtcaacagatggatcactggaatgtggggattctgaaacagaaatgaaactgtccttttgacaactctcttatataataaagtatcaccggcttgtgtatgaaaaaaaaaaa

SEQ ID NO: 776 - DNA, 1498 bp, Homo sapiens
  CDS (64)..(1374)
aaaatccgaagccttcatacagatgccttgaagaaactggctgttaaatgcgaagaccttttcatggctgggcagaaagaccagctccgttttggagtggacagctggtcagacttcaggctaaccagtgacaaaccatgttgtgaggcaggtgatgcggtttactatactgcttcatatgcaaaagatccacttaataactatgcagtcaagatctgtaagagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagctacccagtataaaaagtgtgatgagttccagacaggcatcctcatctatgagatgctgcacctacccaacccctttgatgagaacccagagctgaaggagagggaatacacacgagcagacctgcctcgcatcccattccgctccccctactcccggggtctgcagcagctggccagctgcctcctgaatcccaacccttctgagcggatcctcatttcagacgccaaaggcatcctccagtgtctgctctggggcccccgcgaagatctcttccagactttcaccgcctgccctagcctagtacagaggaacaccctgctccaaaactggctagacatcaagcgaacactgctcatgatcaagtttgctgagaagtccctggacagggaaggtggaatcagccttgaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctaaaaaaaaaa

SEQ ID NO: 777 - DNA, 2742 bp, Homo sapiens
  CDS (103)..(2607)
aaggatccttaattaaattaatcccccccccccgagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaacacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagtgagtgccacttgtctgcagggccgtaccgcggaaccctctttgccgaccagccagtgatgtttgtctcgcctgccagcagccccccagtggccaagctctgtgaactagtccacctgtgcggaggccgggtcagccaagtcccccgccaggccagcatcgtcatcgggccctacagcggaaagaagaaagcaacagtcaagtatctgtctgagaaatgggtcttagattccatcacccagcacaaggtctgtgcctctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcaaaaaaaaaaaa

SEQ ID NO: 778 - DNA, 3829 bp, Homo sapiens
  CDS (2709)..(3167)
ctgaaaggccataggcaccattattgattactctctggcacccaggtttccttagtttcggttgaagtggtggattggacgatacatttaccagaaacagaaggctgtttcgattatcgactcataagggatttggctcagcccaagatcgcacagcgagtcagggcactcgccctcacatgcgcagcgcggtacacctgccgagggtgcacggcaacgcatgaggcattagccggctgcgaacccgggctcagggtctgggcagcttggcacaggtttcagaccagggaccgacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctcgggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcatcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattacgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcctgccgggctcagcaggggaggctgctacggctgcccacttcccagcaccgtctgtcaggcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacctaagagaaacaggaaaaaggttacatgtttttgtttactgagagtaagatcacctgcatctggaagacgggctggtaaattggtttggctacagaacagaaagaaaacaaaaacaaacctcgtaagggaagtatcgcactcagacaccaccacttcctagagccaaatgagcaatcccaaactgcaagtgccgtaagtgggcctgtgacgtcacaccgcccggcccgaggtatcgcatgtgcgggggaggcccacactacagctgtcctctcgtctagaaggcaccacctcgctttcatgtcccgtgtgttttggaaaagcagtatggtgtgtcatgtctagcggcgaacacttccctccctctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaaaaaaaaaaaa

SEQ ID NO: 779 - DNA, 1426 bp, Homo sapiens
  CDS (184)..(1248)
tttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtgagtgccacgctggcaggcacaactgtgtctgctctctcctctgttgccctctgggtgggaagagaccctcaggttggtggctgctgggaccagactgtgatgttttcctcttttctcaccttcctttccccttatcctcagtcctgtttgttttggggctggccaaaaaaaaaaaa

SEQ ID NO: 780 - DNA, 3310 bp, Homo sapiens
  CDS (55)..(3036)
tgcgcgggcggaggagtgtgacgggccttagggccgctgtggatggtttctaaaatgatcattgaaaacttcgaggcactcaagtcctggctcagcaagactcttgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtgccaccgccaggtccattgccacccagtctcccacctgttacagatgatatttcttattctttggttttgacaggaccaccacctccacttcctcctttgcagccatctggcatggatgctcctccaaactctgcaaccagttctgttcctactgtagtaacaactggcattcatcaccagcctcctcctgctccaccctctctttttactgcagtttttgtattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgtattgcattaatcagggcataactaatattctcctgttc

SEQ ID NO: 781 - DNA, 721 bp, Homo sapiens
  CDS (57)..(383)
tttcgtcagagacgctgcaaattgcttgtggacggtgtaggccgctgcaggccaccatgaaccggcttccggatgactacgacccctacgcggttgaagagcctagcgacgaggagccggctttgagcaggtgggctcccgccccaccctggcccccgaggatttgggtcgaggcctggctttggtcgcctccattcgttgcgcctgccgagcctacgcagaccctagcggctcgggagcctgtcgtgcctgttacttgtgcgaagccaaagggctttcctgatggggtcgcgcagtcccggggggaggcggtgccgatgtcgcctgtaggaagagggatattccggaatcacgggggaccgcgtgtaaatcttcaaaagcaatgagatcgaaacctgtctctacaccttagtagcagagtgacggaagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggagatggaaagttgcacagctccgacaggtactacgatgatatatattttgatctgattccgagataagacgagcactcagttgacagaaaaaaagaa

SEQ ID NO: 782 - DNA, 1748 bp, Homo sapiens
  CDS (13)..(1365)
cgcactctcgggatggagggcgagcgccgggcatcgcaggcgccctcctcgggcctcccggccgggggcgccaacggggagagcccggggggcggcgccccctttccgggcagcagcggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggaatcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaaaaaaaaaaaaa

SEQ ID NO: 783 - DNA, 1094 bp, Homo sapiens
  CDS (270)..(788)
attgggttccggggagggtcacagaggtcagtgagtgggtggggggagccccctggatgcctgcttcagcgaattccatttgaggcctctgccaccgctgcatttctgcctgctggaagctgctgggtagtgggaccattgtgtagggaggcttaagggatttggggaacctaagggggcaaagaggccagtgaccaggctcagctcagtctgcacagaggggccgtggcagaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcgcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgataagactcaagtccccgtctgcctggcaggttgttagaaaaatggactatccattagagcaactttctggggcctaataaaattgatgtgaaactaaaaaaaaaaaa

SEQ ID NO: 784 - DNA, 2634 bp, Homo sapiens
  CDS (66)..(2438)
aggccacaaaagaagctaaggagagcaagaagccagagagcaggaggtcatctttgctgtctctgatgacggggaagaaggatgtggctaagggcagtgaaggtgaaaaccttctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgtcctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggggctgccttgctggtggaaggacacagcagttgtccccaggagctgaaccctgcatggtctgttgctggaaacgcgtctgacggagagcctcctgagtctccccacgcagaggactcagaaagggaatcggaggagagtttctccgaagtccccatgagtgaagcaagctcagcgaaagacactccactctttaggatggagggagaggatgcccttgtgactcagtatcagagcaaagccagtgaccacgaaggtttattgtctgaccccttgagtgaccttcagttggtctcagattttaaatctccaatcatggccgatctgaacttaagccttccttccattcctgaagtcgcatcggatgatgaaagaatagatcaggttgaagatgacggagatcaggttgaagatgatggagagacagcaaagtcgtcaactctggacataggagctttgtccttgggcttggtagtcccctgtcctgagaggggaaaggggcccagtggcgaggcagataggttggtactgggggagggcctgtgtgatttcaggctgcaagcaccccaggcatctgtgacagctccttcagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacagacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcggtgataaccagccagcaggctccgaatcaccatctccctcacatgttatccggcaagagtgaattataccaatggaagccaggttaatgattacaattaatctttactgtacattc

SEQ ID NO: 785 - DNA, 2380 bp, Homo sapiens
  CDS (359)..(1618)
tttcgtggagaggggctgttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgttaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaa

SEQ ID NO: 786 - DNA, 2452 bp, Homo sapiens
  CDS (359)..(1690)
tttcgtggagaggggctgttgatatcaatatggcggttgtcagccagacaaagacagtcagtctgatgtgattgagacaagggaggtttttcagggggagactgggagataggggcctcccctcccccttctcctcttcctgcgccggcctcaacccctccccagtcccctcccgacgggcgccccacgcggaagacacccctccccctcccgccttccctcctccctatctcagcccttcgtactgggacgttggggagggggctgtgccgggcggagagaactcagcgaggattctgagaatggtagataacgcagatcatctctggaaaggatattgatccgcctcatgtaaagtatgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgttaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatacttggcaagtacgcaatggggaggaggaggagggaagaagttcagagggaggcagagaagcagagaaggatgacagtacgagccatagtgaccaccaagaccccatctcattagctgtggaaatggcagcagtcaaccacactatcttggcattggcccgacaaggagccaacgaaatcaagacagaggccctggatgatgactgatcagggaggttaaacatgacaagttaacttagtttagacgtagcaccttagcagactttcctcggtccttaacatgtgttcttacagtataacttgcagtttcttgtatgtcaggtagctgttagggtcttgttctgtgaagatggcatggtgccctcagcctttgcatatactctctcagtattaactcccagtaaataataaccaaccaaccaaccaaccaaacttccctctcccagcccccgaggctagaaaatcttgctgctccgtcttagcattccaagaaagtgcttccaggtatttagatagccctcagttctcaaatattagactacgtgtaaaatcttgggtacctttagattcttgtaacactagtctgtactcccttttccttccccaagactgataggatgcaagctgaggtcgtggcacaggaatgacagacaccatttggggagtatccacagagtcaaaggaacactagaatccccacctcagcgtgaggataattgatttccagctgcaataagccgtgcctcattatagccacactgtggctagattatacttctttgggtgctgtgctaagaatgtcaatggaaaaagccgatctcagattttgtttgaagttaacatgcctgacacagacatcctttcctctcacaagctgtgtgacttagtagataaaatactgccttctgcctttgggaccatgattaaaaacaaagacaaaaaccaaaagtcattaaaaaaaaaaaa

SEQ ID NO: 787 - DNA, 531 bp, Homo sapiens
  CDS (40)..(528)
gatttccaaacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccagaagatagtactttccctgcctgttcagtgggaggtatacctggttccaagaagtggttctttgcagtgcaggcaatatatggattttatcagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgagtatgcttatatggtttttgtattatcattaaaatacttaatattagacagttattttaatccatga

SEQ ID NO: 788 - DNA, 1598 bp, Homo sapiens
  CDS (55)..(1461)
cacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgagggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgtgtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagcctgagagaactccagaaatcgctggtggaagctcaggcggggctccgggccacggggaccgggggtctctcgggtgcgttggtgggcccctgggggggcgagaggggggcccgggggggggggggatgccggggcaca

SEQ ID NO: 789 - DNA, 2042 bp, Homo sapiens
  CDS (1)..(1863)
atgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcgaatggaaacatacttaggataatccttgagtgataatatattttatattttgaaaaatgatttcttccaggccctaactttttttaaaaaaatgttaagcatacgaagagtggatctcacaatacacattgttctatgttgctattcttagatgtgcattgatatttctaaagtgtttcaaggtcatttggcagaacc

SEQ ID NO: 790 - DNA, 1778 bp, Homo sapiens
  CDS (279)..(791)
cgcccagatcgcgctccgagtcgacgagggggctcgtgcaggtccggcgcgcgcgtggggagcggcccgggggcgccgagggagccggcggcagcgaggatgccggcacggggacgcggctgcctgctgggggtgtgagcgagaggctgagcgctgcccgctcggcgcatccattccgcaccgccccctccctgcgggcctcggaggaagccccccgcgctgtgcggaggcgcctcggctgccgggctgcggagccccggcccagcaggagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgctaaacagagtttgaaggagtgcattcccagaagcagaacagacagacctgcgtccggaagagcctcatatgcgcctttgctatggccttcatcatcagtgccatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagcccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttaaaaaaaaaaaa

SEQ ID NO: 791 - DNA, 974 bp, Homo sapiens
  CDS (69)..(890)
ttaagctggtgtaaatcggccgaggttctgagctcgggtcaccctgccccatctccatctcctatgagatgagtgactcccaagaccccaccacttcccctgtagttaccacccaggtagagctggggggctgcagccggcaaggtgggggcaatgggttcctccgttttcgccagcaccaggaggtccaggccttcctcagccttctggaggacagttttgtccaggaattcctctccaaagacccctgcttccagatttcagataagtatctcctggccatggtgctggtctacttccagcgcgcccacctgaagctcagcgagtatacccacagcagcctgttcttggccctgtaccttgcaaacgacatggaggaggacctggagggccccaaatgtgagatttttccatgggccctgggaaaagattggtgtttacgagtggggaaattcctgcaccagagggataagctttgggcacggatgggtttccgggctgttgtgagccgccagtgctgtgaggaggtcatggcaaaggagccattccactgggcttggactcgggaccggcgcccccaccatggtggggttcagagggtctgtccacaggtccctgttcgccttccccggggccctggcctctcgccgccccactgttccccctgtggtttgccccagcactgcagcagccacttgcttaagcctgtgtcatccaagtgcccttctctgacctctgaatgtcatcgccctccctcccaaaattatctctcaagggtcaaaaacgcctggggtggggactttctcatcgtcttgcctccccagatgcaactggaaccaggcacctactccctccgcatcttcccaaagcctccggcacgccctgggcactgaagctctgcagggtgaagaacagcacgcctgctggcccactgactgacacaccattggctgtgctcccacccctgccccttc

SEQ ID NO: 792 - DNA, 1647 bp, Homo sapiens
  CDS (37)..(1491)
tttcgtggagaggaaggggcagccctggggaaggcgatgcgtggaggaggctgctcaccccattccccatctgggtgtctttcaggagtcatggccggcttcaacatggggggcgacctcagggagcctgccgccagcattcccctgggctccctggcagctgttggcatctcgtggtttctgtacatcgtcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcagtccccccaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccc

SEQ ID NO: 793 - DNA, 3175 bp, Homo sapiens
  CDS (1750)..(2415)
cgcggtacaccgatgcgctatacaaaggcactcgccgccagcgccgcagtgccagagatgagctcccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagcccactaatgctccagaaccctcaggagaagagccaggcctacccccgccgccgccggcctggctgctacgcatagcgtcagaaccccgaggccatcgcagccgcagctatgtacaccttcctgcccgacaacttctcacctgccaagccaaagccttccaaagagctgaagccgctgctgggctccgcggttctggggctgctgcttgtgctggccgcggtggtggcctggtgctactacagcgtctccctacgcaaggcggagcgacttcgcgcggagctgctggacctgaaagctggcggcttctccatccgcaatcagaagggagagcaggtcttccgcctggccttccgctccggcgcgctggaccttgactcctgcagccgcgatggcgccctgctgggctgctcgctcacggccgacgggctgccgctgcacttcttcatccagactgtgcggcccaaggacacggtcatgtgctaccgcgtgcgctgggaggaggcagcgccgggccgggccgtggagcacgccatgttcttgggcgacgcggcggcccactggtatggtggcgccgagatgaggacgcaacactggcccatccgcctggatggccagcaggagccccagccgttcgtcaccagcgatgtctactcctccgacgccgcgtttgggggcatcctcgagcgctactggctatcttcgcgcgcggccgccatcaaagtcaatgactcagtgcccttccacctgggctggaacagcacggagcgctcgctgcggcttcaggcgcgctaccacgacacgccctacaagccacccgccggccgcgccgcagcgccagagctgagctaccgagtgtgcgtgggctcagacgtcacctccatccacaagtacatggtgcgtcgctacttcaacaagccgtcaagggtgccagcacccgaggccttccgagaccccatttggtccacatgggcgctgtacgggcgcgccgtggaccaggacaaggtgctgcgttttgcccaacagatccgcctgcaccacttcaacagcagccacctggaaatcgacgacatgtacacacctgcttatggcgacttcgacttcgatgaggtcaaattccccaacgccagcgacatgttccgccgcctgcgcgacgccggcttccgcgtcacgctctgagtgcacccttttgtcaactacaactcgtcgcgcttcggcgagggcgtggagcgcgagctgttcgtgcgcgaacccacgggccggttacctgcgctggtgcgctggtggaacggcatcggcgcggtgctagacttcacgcacccaaaggcccgcgactggttccagggacacctgcggcggctgcgctctcgctactccgtggcttccttcaagttcgacgcgggcgaggtcagctacctgccgcgggacttcagcacctaccggccgctgccggaccccagcgtctggagccggcgctacactgagatggcgctgcccttcttctcgctggcggaggtgcgcgtaggctaccagtcacagaacatctcctgcttcttccgcctggtggatcgcgactctgtgtggggctacgacctggggttgcgctcactcatccccgcggtgctcaccgtcagcatgctgggctacccattcatcctacccgatatggtgggcggcaacgccgtgccccagcggacagccggcggcgatgtgcccgagcgcgagctctacattcgctggctggaagtggccgcctttatgccggccatgcagttctctatcccgccctggcgctacgacgcggaagtggtggccatcgcgcagaagttcgccgccctgcgggcctcgcttgtggcaccgctgttgcttgagctggcgggcgaggtcaccgacacgggtgaccctatcgtgcgccccctttggtggattgcgcccggcgacgagacagctcaccgtatcgactcgcagttccttattggggacacgctgcttgtggccccggtgctggagccaggcaggcaggagcgcgacgtctatttgcccgccggcaagtggcgcagctacaagggtgagcttttcgacaagacgccggtgctgctcaccgattacccggtcgacctggatgagatcgcctactttacctgggcgtcctgacccagcccagggcccggtaaccgcaaagcccccagtcttcatgcagaccttgaaccctccgtcacacccgcaccatgtactcccaggaacctcccacctctataccacccattaagtggctgctgacttaaatgtgctggaaccagctgctgaaggtggggcctagggagggggcactgaagcaatctcctgctccaacgcacaatccttactgtgccctttccacccccacactcacaccaatctgcagaaacctcttccctggggtggaagccagagagcttagaggaaaaaggtcagctctcttcctgttatacatggttatacatggttggggtttaaaagcacaaagagaaacctccccctcctggctttcgtggccatctttgtccatcttaggtggggacttgatcttatttaaggtctccaaatagcccccaccacacttagaacgtgtgttttcttagtgttagaagccaggccctgagtccccagcactcacctgaactgtggctgatttggtcccagtccagctggggaggtgtttggctgacaaggaggcaagagatcccctcccagggaacaggaggactgggcttagcacagagccatcatcatgttcccaatttgtgaagagactcctaacactgcactaacccatttgtgtacatacatgggctcagccctgggccaaatgtgcctgatgggaacagacttgcagggccatgcaggccagacttcgtgccttaactgaaga

SEQ ID NO: 794 - DNA, 2277 bp, Homo sapiens
  CDS (252)..(1133)
gatggcagattcttcttctgagatgatgattggaactcatgaaacatgacacatttagacagcccagcgttgatgaattagaaggcaggtcctttcggttggagttgaaaaaagaatggtccccgtgcagcagcttctcagatcctgagtcagagaaaagaaacacctgtgtgttgagagaacaaatcgtggctcagtaccccagtttgaaaagagaaagtgaaaaaatcattgaaaacttcaagaaaaaaatgaaagtaaaaaatggggaaacattatttgaattgcatagaacaacgtttgggaaagtaacaaaaaattcttcttcgattaaagtagtgaaacttcttgtacgtctcagtgactcagttgggtacttattctgggacagtgcaactacgggttacgccacctgctttgtttttaaaggattgttcattttaacttgtcggcatgtaatagatagcattgtgggagacggaatagagccaagtaagtgggcaaccataattggtcaatgtgtaagggtgacatttggttatgaagagctaaaagacaaggaaacaaactacttttttgttgaaccttggtttgagatacataatgaagagcttgactatgctgtcctgaaactgaaggaaaatggacaacaagtacctatggaactatataatggaattactcctgtgccacttagtgggttgatacatattattggccatccatatggagaaaaaaagcagattgatgcttgtgctgtgatccctcagggtcagcgagcaaagaaatgtcaggaacgtgttcagtctaaaaaagcagaaagtccagagtatgtccatatgtatactcaaagaagtttccagaaaatagttcacaaccctgatgtgattacctatgacactgaatttttctttggggcttccggctcccctgtgtttgattcaaaaggttcattggtggccatgcatgctgctggctttgcttatacttaccaaaatgagactcgtagtatcattgagtttggctctaccatggaatccatcctccttgatattaagcaaagacataaaccatggtatgaagaagtatttgtaaatcagcaggatgtagaaatgatgagtgatgaggacttgtgagaattcagtctactggatttaagggaatggcttatggagttgttatttcataggcattgaaaatggttttctaaactccaaaatggtcatcttatcaataataataatattgaccatttcctatctgccaggcatttttctaagcacatgaagaaattagtcctaacaacactatgagatggactataacttgcccaaattctttctttctctttttctgtgagaacgtgtagttctcacctcgtgctcgccgtgggccgtggagtatcacacggtgaggtgcagaactcttccagccttcactgtgcccaaactttcacactcctctccacgcgtctctcaccgccgtacttctttattgcgcttcaagtatcctccctgtgagccacgctgtgcggcacttacctcgcgtaatacacccgctcactacgaacgccaccaccagcgctagcaaacttttatatcatatctattcctgtattagcgtgcgtatctctcttttctagcactggacagatatcaccacggtgtcgtatctcgacacctccagttgtgttgtgcgctccacacgcgtgcgacgtcgctcctgtcaatatcacatcgaagttgagcgcccccagttgcgtagtaacatcccaacacactcatcggacaactctcgtagagccctcccacctccacacacgacagcgacgcagtctacgcggcgcatatattttctcacacaagcactcgactagctgtacaacgcccctaacgtattggttcccactcgcacgggaggtctaaaaacctcatcctcgtcgccccacccaaaacattaacaaacaaagtaactacgtcactatcccaaccacctataccgcttgtcaaccatcctctctactttactctaccctcctccacatacatcacaccatatctacagcctacccatccacccccctaactctctactaacattcttgttactcatccctttatcacactcaactgtatctacctccacaataatcacacaatcacacatacaaccctatcacctctatcactacctaacaaacctactcaacatctccacttacttcattctcctttctattagcacactcataactacaatccttacaccactctcacc

SEQ ID NO: 795 - DNA, 1321 bp, Homo sapiens
  CDS (176)..(841)
gaaattggctgagagaaaaggtcagggtcaggaataacagtttcattatctgagcaactggacatagaggctggcacttgggcacattgtcacaaatctttgtgttgggattaatgccactaacctgtagtgttggggttccatctctgatcattatcagctaaaaatcttcaaaatgtttgtcatgcttcaggtgccctggctgcagagttgtgccaacttggtgcagattggggcacctctcccactactgggctgtttgggccagtattttgaggttctgggaagtatggaagtactggctgggcaatatgggaaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaaggcctcttagatccaaacgtcaagtcaatttttgtcacctgtggagactgggacttaaaagtcatgctcccaggccagtgccagtacttgggcttgccagtggcggattacttcaagcagtggattaatctgaaaaaggcttacagcttcgccatgggctgctggcccaagaatggacttctagacatgaacaagggcctcagcctgcaacacataggccggccccacagcggcattgacgactgcaagaacattgccaacatcatgaagacactcgcctatcgaggcttcatcttcaagcagacatcgaagccgttctgattggccgaggacaggatggggcaggacagggtagctgtttggcccagcccagaatcctcctctccctcaccagaggggaagagggagagtggcatagctctgtgtccagagtgtccccagctgccctgtgggctcatgcccttggcgtgggcttgtgcccttgcaagggcttggccacttggcccttctggagcagacactttgtgccccccatccccacccctcaatctcagcccagtatcagcccctcccattgcgggcctgggctagggggacccaggcactcaccgcctcctccctggtacacaggcttctgtggggccaccaagcccctcctgtgccccctcccatccatagtgcatggtgtgtggtgcccccagggctccaggacagatcaggccccaccttgtgtctacccccatccccgctgtgaacgtgccactgaataaagtcggggaaacgagaaaaaaaaaaaaa

SEQ ID NO: 796 - DNA, 1051 bp, Homo sapiens
  CDS (40)..(600)
ggagcgggtggcggaggcgattgaagctgctggcccagcatgtggtgcgcgagcccagttgctgtggtggccttttgcgccgggcttttggtctctcacccggtgctgacgcagggccaggaggccgcggggcggcgaggggccgactgtgaagtatgtaaagaattcttgaaccgattctacaagtcactgatagacagaggagttaacttttcgctggacactatagagaaagaattgatcagtttttgcttggacaccaaaggaaaagaaaaccgcctgtgctattatctaggagccacaaaagacgcagccacaaagatcctaagtgaagtcactcgcccaatgagtgtgcatatgcctgcaatgaagatttgtgagaagctgaagaagttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacaccccaaaacagagctctgatctccaatgccagcacatttgtgacttgtaattagagagaaaagtgactctctaggatatggacatgttgattaaggataactgggaatgcatcatatttggtctcatgctttttgtgttggtattattcctcagaattttgttacgtgggtttatgagtgaaactaatactactgataacttacatttgcagtgtaccaaaagctaaaagttcctttctcataagtttcttggaatgactatgccagttttcattgcctgtctcctaaaagtgacctactgacaaattgatggagtaaattgattccaagaaagaagaaggcattcagagactcctctctggatgcaattttaaaatatattggactaaaacaaaagacacaacagtcagcttatctaatgcacaacttcaatcccaaatacagaatcaaaagttaaaaaaaaaaaa

SEQ ID NO: 797 - DNA, 6127 bp, Homo sapiens
  CDS (241)..(5259)
atgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaaaaaaaaaaaaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaagagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtt

SEQ ID NO: 798 - DNA, 6178 bp, Homo sapiens
  CDS (241)..(5310)
atgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaaaaaaaaaaaaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaagagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtt

SEQ ID NO: 799 - DNA, 1350 bp, Homo sapiens
  CDS (171)..(1034)
tttcgttgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctgttcccgcaagcccagacaatgccggtggaggaatttgtggctggctggatctctggcgctctgggcttggtcctgggacacccgtttgacactgtaaaggtgaggctgcagacccagaccacctaccggggcatcgttgattgcatggtcaagatttaccgccatgagtccctcctgggcttcttcaagggaatgagcttccccattgccagcatagctgtggtcaactctgtcctgtttggggtctatagcaacaccctgctggtgctcacggccacctcccaccaggagcggcgggcccagccgcccagctacatgcacatcttcctagcgggctgcaccggggggttcctgcaggcctactgtctggctccttttgacctcatcaaagtccggctacaaaaccagacagagccaagggcccagccagggagccccccaccccggtaccaggggcccgtgcactgtgcagcctccatcttccgggaggaggggccccgggggctgttccgaggagcctgggccctgacgctgagggacacccccacggtggggatctacttcatcacctatgaagggctctgtcgccagtacacaccagaaggccagaatcccagctcagccacggtgctggtggcagggggctttgcaggcattgcttcctgggtggcagccacgcccttagacgtgatcaagtcccggatgcagatggatggactgagacgcagagtgtaccaggggatgctggactgcatggtgagcagcatccggcaggaaggactgggagtcttcttccggggggtcaccatcaacagtgcccgcgcctttcccgtcaatgctgtcaccttcctcagctacgaatatctcctccgctggtggggatgagccctgcggcaatgccagcagctccccatcaggcccacggcctggaggccagtttgagattggaggccaggttgaaagcttgcaaatcagtgcaagaggctcagcccttcctaaccaaggtgcctcccacccgcgcagatctgggctgggcagacacctgtgggagccggaagccagggggcctgtgcagcctccctgtgtagctggccttgactcctttgcctcccacatctgtgaaacagggagcatgaggcacaagtgagctggcaagtggtgctggtgacatcccagctcctgtcctgtgccttcacct

SEQ ID NO: 800 - DNA, 1975 bp, Homo sapiens
  CDS (1)..(1365)
atgactgggacccacttacataggactatcaaaacttatctgcagcaaattggagttgatatggataaaatacatggccaggcctatgatagcaccactaatttgaagataaaatttaataaaatagcagcagaattcaagaaagaagaaccaagagctttatacatacattgttatgcacactttttggatttatcaataattaggttttgtaaagaagtaaaagaactccgaagtgctctaaaaactctcagttctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatataggtcacattgcacatgagtgagttactgtaagctggaaatctaaagttagaattactaggttaagatatgtgcatttttacttttgatagatattggcaagttgccatctataaggattgtgccagtttacagtcccacccacaatgcatgagagtgcctattaaatctttgtaagtgttaaaaaaaaaaaaaa

SEQ ID NO: 801 - DNA, 3049 bp, Homo sapiens
  CDS (386)..(3046)
ggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtga

SEQ ID NO: 802 - DNA, 3398 bp, Homo sapiens
  CDS (249)..(1844)
tttcgtgcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaacgcgctacagaggatcctgtgtggtcgagtgaccgatgggaaggcctgcagacggaccatgaggaagcacacagacgggcagcatttgcgtgcagcaggacccaagggggcaggcctagctcaagctggggccccgagacaacgtaagcgggggcaaagcccacgacagcagaggtccaccccaagtaccaggaaatgcaggtggaaagccacgcagagcgcacgagggctcaacggaagaccgctgagaagcgatcacacgcgcagcaacgacccaacgcagatacccgcaaaagtagaggataagacaagacaccagg

SEQ ID NO: 803 - DNA, 2307 bp, Homo sapiens
  CDS (172)..(2304)
tttcgtcaggaacatcccagagagagctgggcccatcctcagccctacccagccccgcagcccctagccctccgcccagaaacccagccctgtccggcgtgccgctcttctcctccaggccggctgctgctgcggccagcgttgccggggcatcccttcctccttcccatcatggcagtgtaccgcctgtgtgtgaccactggtccctacctgagggccggcacactggacaacatctctgtcacactggtgggcacgtgtggtgaaagccccaagcagcggctagatcgaatgggcagggacttcgcccctggatcggtacagaagtacaaggtgcgttgcacagcggagctgggtgagctcttgctgctgcgtgtacacaaggagcgctacgctttcttccgcaaggactcttggtactgtagccgcatctgtgtcaccgaaccggatggtagtgtatcccacttcccctgctatcagtggattgaaggctactgcaccgtggagctgaggccaggaacagcaagaactatttgtcaggactctcttcccctcctcctggatcacaggacacgggagctccgggcccgacaagaatgctaccgctggaagatctatgcccctggcttcccctgcatggtagacgtcaacagctttcaggagatggagtcagacaagaaatttgccttgacaaagacgacaacttgtgtagaccagggtgacagcagtgggaatcggtacctgcccggcttccccatgaaaattgacatcccatccctgatgtacatggagcccaatgttcgatactcagccaccaagacgatctcgctgctcttcaatgccatccctgcgtccttgggaatgaagcttcgagggctgttggatcgcaagggctcctggaagaagctggatgacatgcagaacatcttctggtgccataagaccttcacgacaaagtatgtcacagagcactggtgtgaagatcacttctttgggtaccagtacctgaatggtgtcaatcccgtcatgctccactgcatctctagcttgcccagcaagctgcctgtcaccaatgacatggtggcccccttgctgggacaggacacatgcctgcagacagagctagagagggggaacatcttcctagcggactactggatcctggcggaggcccccacccactgcctaaacggccgccagcagtacgtggccgccccactgtgcctgctgtggctcagcccccagggggcgctggtgcccttggccatccagctcagccagacccccgggcctgacagccccatcttcctgcccactgactccgaatgggactggctgctggccaagacgtgggtgcgcaactctgagttcctggtgcacgaaaacaacacgcactttctgtgcacgcatttgctgtgcgaggccttcgccatggccacgctgcgccagctgccgctctgccaccccatctacaagctcctactcccccacactcgatacacgctgcaggtgaacaccatcgcgagggccacgctgctcaaccccgagggcctcgtggaccaggtcacgtccatcgggaggcaaggcctcatctacctcatgagcacgggcctggcccacttcacctacaccaatttctgccttccggacagcctgcgggcccgcggcgtcctggctatccccaactaccactaccgagacgacggcctgaagatctgggcggccattgagagctttgtctcagaaatcgtgggctactattatcccagtgacgcatctgtgcagcaggattcggagctgcaggcctggactggcgagatttttgctcaggcgttcctgggccgggaaagctcaggtttcccaagccggctgtgcaccccaggagagatggtgaagttcctcactgcaatcatcttcaattgctctgcccagcacgctgctgtcaacagtgggcagcatgactttggggcctggatgcccaatgctccatcatccatgaggcagcccccaccccagaccaaggggaccaccaccctgaagacttacctagacaccctccctgaagtgaacatcagctgtaacaacctcctcctcttctggttggttagccaagaacccaaggaccagaggcccctgggcacctacccagatgagcacttcacagaggaggccccgaggcggagcatcgccgccttccagagccgcctggcccagatctcaagggacatccaggagcggaaccagggtctggcactgccctacacctacctggaccctcccctcattgagaacagcgtctccatctaa

SEQ ID NO: 804 - DNA, 918 bp, Homo sapiens
  CDS (195)..(620)
gcacacgggagaggagaagagggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagatggcagccagcagctctgagatctctgagatgaagggggttgaggagagtcccaaggttccaggcgaagggcctggccattctgaagctgaaactggccctccccaggtcctagcaggggtaccagaccagccagaggccccgcagccaggtccaaacaccactgcggcccctgtggactcagggcccaaggctgggctggctccagaaaccacagagaccccggctggggcctcagaaacagcccaggccacagacctcagcttaagcccaggaggggaatcaaaggccaactgcagccccgaagacccatgccaagaaacagtgtccaaaccagaagtgagcaaagaggccactgcagaccaggggtccacgctgcgagtctgcagcccagctgaaccagaccagagcctgatcccaaccgcatgacacagggaacagaattcacaagccataaaccgcagaggcgaagaccattgcagcaagaagctaccctacccaacagagagcaacaaaccaatacgactactagaatgacaagagtacagcgagcagcagagagatagcggcgacaacgcaaaggacgagaggagaaaagacagacggaaacacatagagaagacacaccaacagaccatacgcagacaaagagaacacacaaagaacaaggcacgaagagagagggcacacaaccaccagcgaccaccgagaacgacccagcagc

SEQ ID NO: 805 - DNA, 986 bp, Homo sapiens
  CDS (284)..(853)
atcgtggagggggaggtgtgtcctctctccccatgatcggctgcagttcccattttgtcttagatgttatacctggggtgggggcacctcacactgccccagaggatgcccctgagcaggaatcgcgggggtggagaggagcgaaggtgccccccttggagcccttttggagctccggctgcagcccacactcctgctcagaagtgcgcctccgttggggatccaggtccaaggcctgtcaccgtcccgcccacaggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctggcgcctgttcccccaggctttcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaaaaaaaa

SEQ ID NO: 806 - DNA, 1749 bp, Homo sapiens
  CDS (477)..(887)
ggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgtgcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagacacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcccgcccttgcagtccctatttcaaaataaaattagtgtgtccttgcctgtctgtggcatatttgtgcatgggacagggcctgtggtggggtcacttgagttgagccggagcacatgggggaaggggtgggcagtggggcaggaggggctggcctgcctgagtgggaagcacgcccttgggctcacactctcactgagccttgctggtggccccaagacacgcaatgtcaggccatggctgggtcaaggcagaaggccttggtgcacacccaggggccatagtcaacgaagc

SEQ ID NO: 807 - DNA, 2093 bp, Homo sapiens
  CDS (1340)..(1705)
cttggcgaaagtaaaagggataattaactggctcttagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaattagccattttcctcaagaaaagtgattcttctgaatcttagcttttcagtaatgagaactggactgtttccacttgacctctatttcctgttagtgggaaaccgcttcccagaggtgctgtgtgaaagattgctggggaaagggtttctagatcccagcataacaagttcaagagtccagcgatattgtcattagaataatggtcttcattaagtactagttttcataatcctgaagcttcattttcaccaatttgaaaggcagctagggaggagaagactatgcagggaaggaggaaaactctggagtgcatcacagagaccttgagtgagttaaggcagggaagaagcagatttgctatccactgaatgaaaataagaagaattccattgtccaaggtcagagcaagaacacaaaggttttagtttacttagttaattccttaggtttggacattacaggagacatgggggtgaccatagcaatttagctgataaatgtatcagaaactctttcatcattttctgtcccctcctatcttaggctgaccggttccctgatgtgttacctgcttctgctactgatccaaactgcagaacttctcattcatccccaaggcctccaggcagtatccaatggggaatcagctctaaaaggaaccagaccaacgttttccagccccttcattctggtgactgaggggaggaaagaatgggagggggtattcttgtctagtggatggaaaggaaacacactgtcaaattactatatctccttggttttctattacagtagaattctccagccatatttttattgtctatgggggaagttggagatggtgaccttgattagaagtgtctggagggggataaatggaggggataagattcagttggttttggaaaatgttaaagtcttaaaataatgcgtccatctgaagaattttttctaaaaccagagtttataaaaatatcactgatacagcctgccccctcatttccctgccacaggagatgtcttggactagagacacttgtttaataatagcttgtctctgatattcccagtagcttccctctgtgtgaggaaaggatagaaatgttcaggacatcatcatacaggctcctcatctacaaagttccagtagcagtgacgcctacacggaagacttggaactgcaaacaggctggggtcacctcagtgacatctgacgctgtccaaccagaagttcgatttttgttctgggggtgaaggaggaaacagactgtactaaaggactaaaataatttgtctatactaaaaaaaaaaaa

SEQ ID NO: 808 - DNA, 2979 bp, Homo sapiens
  CDS (271)..(1566)
aaggatccttaattaaattaatcccccccccccctttccctccctctcggcttttccacagtgggtcggaccaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacaaaaaaaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacgaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcccgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaaaa

SEQ ID NO: 809 - DNA, 2174 bp, Homo sapiens
  CDS (586)..(867)
ctgaggaattcggacgaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaaaaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaactataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaaaaaaaaaaaa

SEQ ID NO: 810 - DNA, 1509 bp, Homo sapiens
  CDS (292)..(807)
  misc_feature (1)...(1509): n = a,t,c or g
gcacatccacatagtatgccagtcgctgcaaaccaaaccgcgtgtgtccgctgggtctctgggcatgcagtttgctcccactgcgggaatggggtgggggcaggccgagcctgggctctgggggctttgctgggggagcttctggtcctgggggtacccacttgtgagggagtggggggacagctggaatagcgttgctcagtgcgtcctttgggcgctgttggggacaccctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggacctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcaaccctgcccactcgggcttcatcctgcacacttaactcggtatgccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagngcagcaagggccctggcgaggacttccgcatggccaccctctacagccgaacccagacccccagggctgagttaaaggagttcccgccttctgcg

SEQ ID NO: 811 - DNA, 841 bp, Homo sapiens
  CDS (20)..(808)
tttcgttgcagcatctgccatgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcacctctttagggacagctcgcctgcgagtctatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcaacgccgaagcctggggttgaacagactgaggctttacctgggtgtcctac

SEQ ID NO: 812 - DNA, 992 bp, Homo sapiens
  CDS (207)..(584)
gcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaaattcttccaaggtttgatgcatctctctcagaggtggatattccattcttattataaccaagaaactattaatagcagcaatgaagcatatagaactgatagttaaggcagacggcaagtacaacaatccgggtttttacaggccaaggggcttttagaaggaaattggccgagagcttcaggtggttggagaaagtggaagagaggaattggctatttaggagatttacggaagggttttcctttaatttgggctcctaaagaacgagaggggatttgtgacttattagggagagaatgggggggggggagccaccgttggatgagtgtccgagagggaaagtggtaattagaggagaggcctggaggaagagacggtgttgtcacttggaagggccaaagagtgtggagagagaaacttt

SEQ ID NO: 813 - DNA, 2024 bp, Homo sapiens
  CDS (39)..(1187)
agcccgagccggagcccgagcgccgggagcgagacctcatggcagcggtggcgcccgcgggccccggggactccgcctcggccgccctggacgagctgtcactgaatttcacgtacggggcaccaggcgccggcaacggctccctctcgggcgactggtaccgcaggaaccagattcacctttttggagttttgctggctattttaggaaacttggtgatcagtatttctctaaatattcagaaatattctcaccttcagctggcacaacaagagcacccaaggccatacttcaagagtgtgctgtggtggggtggtgtcctgctgatggccgtgggagagacggggaactttgcagcctatggatttgctcccattactctgatcgctccgttaggctgtgtgtctgttacaggtagtgccattatttctgttacatttctgaaagacaatttgagagcctcagacttactcggtacgacactggcatttgcaggaacatatttactggtgaactttgctccaaatataactcaggcaatctcagcaagaacagtacagtattaccttgtcggatggcagttcctgatctatgtgattttagaaatattaattttctgcattctcctgtatttctataaaagaaaaggaatgaagcatatggtgattctgctaaccctggtggcaattctagcctcattgactgttatttcagtaaaggccgtctcaggcatgatcactttttctgtgatggataaaatgcaactaacttaccccattttctatatcatgtttatcatcatgatagcatcttgtgttttccaagtcaagttcctgaatcaagccacgaaactctacaatacgacaacagtggtgccagttaatcatattttctttacaatcagtgccatcattgcaggtatcatattttatcaggaattccttggtgctccttttctcactgtatttatatatctttttgggtgttttctgtcattccttggtgtatttttggtcacaagaaatcgagaaaaggaacatctgcaacagtcttatattgattttggaaatattcctgggaaacaaatgttggacaaaatacaaccagattcacatagcttatcctatggaactttgcctgatggaagtgactcaacaaagagccaaagtggagagaagaaagaggtctaaatgctgagaaggatggctgttggcctgttattcgataccacctttttaaaaaattgcacatgttcaatttgtgtcagcagctcttttataagctgacatgtgctagcattcatttcagtcctttcccccacctcagcgtctatggacaatcggggacttcctaagctctgacagtctaatatttccatggaatgtgatttggagtgttccccacaccctggacctctccctagtgattatctagccagctacaccttactcagagcccggctgctctagcaggaatgttgcacagaaacatacatttgcggtttggccacaggtcgcataggtggcttctcccacgggtagtgtcagttgcttcactttaaaaagtcacttcagccccacaacctcactcccaaaagaaaggtttgagagcgctcattttttttctaagacaccttttataagcctccctataaaaatctcacctttcaagtactaagttagaattgcaagtcatcttttctgaaaactaatgctatcaaagtcctcctttgaaaattaagggtctctttaaaattagaatttataaatggcattcagtgatagtgtacaccaaaattaaaagaccttgactggtgggctttttacgtgtaaggaagaggaagtttaagaagtaggactctgcttgtttcagtagcccatgtactaaaataggaacaatgcagagattagcacagcccctgcacaaggctgacacataaattcatgaagcgttagagacaaaaagtaggactaatgtttgtttattttttaataaaaatctagaatggtaaaaaaaaaaaaaaa

SEQ ID NO: 814 - DNA, 877 bp, Homo sapiens
  CDS (259)..(870)
tcacactatccgttcagctgtttctggatggtgcagcataaagtatactgtgggtaacagagtatctacagttacctgcccattgccacacaccttgtgctccatatggggttgatcagtcaaaggtgaagttaggtaggattccacactgccacaacaagttctcttgggcccccatataacggtgctggctgaggcagagggactcagggccactctcttgctggcaggtcggatgttcagcagtggtgtcctggtatgccagaacctccaccctctgacgccatggtcagctcctgctgtggctctgtctgctctgaccagagctgtggtcaaggtctcggccaggagagctgctgccgccccagctgctgccagaccacctgctgcaggaccacctgctgccgccccagctgctgcatttccagttgctgcaggccttcctgctgtatctccagctgctgcaaacccagctgctgcaggaccacctgctgccgccccagctgctgcatttccagttgctgcaggccttcctgctgtatctccagctgctgcaaacccagctgctgcaggaccacctgctgccgccccagctgctgcatttctagttgctgcaggccttcctgctgtatctctagctgttgcaaacccagctgctgccagaccacctgctgccgccccagctgctgtatctccagctgctacaggccccagtgctgccagccctcctgctgccgcccggcttgctgcatttctagttgctgtcatcccagctgctgtgtgtccagctgccgctgccctttcagctgcccgaccacctgctgtagaacaacctgcttccaccccatctgctgcggcagttcttgctgctgagtga

SEQ ID NO: 815 - DNA, 1699 bp, Homo sapiens
  CDS (109)..(1476)
ggaaggaagtgagtgccctgtccttcctccctgccatgagattccaggaccggacctggcaagtgccctatcccagccagtgttcctggggctcttccaggcagggctatgttccccaggccaggggcattgtcctggacagtcaggaggcatacccctcgccaggtggaaccaccctgtgtatgcatgaccctgacaagcaggcgccaggacagtcaggaggccaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacaacagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgcgagggtgcgttatactcccgactccactcaggtggactcgagactcttgggccg

SEQ ID NO: 816 - DNA, 513 bp, Homo sapiens
  CDS (1)..(411)
atgctccaaaagaagatagaagaaaaagacttaaaggttgatgtgatcgtgacactgggaggccttgctgggcgttttgaccagattatggcatctgtgaataccttgttccaagcgactcacatcactccttttccaattataataatccaagaggaatcgctgatctacctgctccaaccaggaaagcacaggttgcatgtagacactggaatggagggtgattggtgtggccttattcctgttggacagccttgtatgcaggttacaaccacaggcctcaagtggaacctcacaaatgatgtgcttgcttttggaacattggtcagtacttccaatacctacgacgggtctggtgttgtgactgtggaaactgaccacccactcctctggaccatggccatcaaaagctaacctgttgactggtatccataagtgtgcctctgccttatctcatatttcaacagttcattgctcatcaagaacgattcacctggggttgtcagaatttag

SEQ ID NO: 817 - DNA, 2223 bp, Homo sapiens
  CDS (50)..(2149)
tctcgggtcgacgatttcgtcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacaccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtcagcgctttgcgaggccctgagaaccagcgcagagctcatgtggagcaccagcatgagtggccctgagctgggcatccagtttgctgggaaatgctggcttccgggaaagctgtaccagaacctcctctttgcagcccacacagccctaagccagcaggaaactgaaatgtttgtcttcagggtcagaaaacctactcagcagtacagtgggaagaactgaactagagccagaagacctgggctccagcccagctgcaaaccctgtgcacgtccttaatagcttcatgcctc

SEQ ID NO: 818 - DNA, 3280 bp, Homo sapiens
  CDS (5)..(2164)
gcagatgcaccccaagtcaataatcacattcagagagataaatggggagtacactggggctgtggattttcccaggctaggagtccgtgcttctgaggaaacagcgctcagagagctgaagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagctcagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagttctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagttaaaaaaaaaaaa

SEQ ID NO: 819 - DNA, 2646 bp, Homo sapiens
  CDS (106)..(2217)
ggctaggccggctcgagactcccgggcgccgaggcgctgccgcccgcctcgccgccccacgccgaaggaccacgcgcccgccgccgccagcctctcagcgctcccatgatcgcccggtgccttttggctgtgcgaagcctccgcagagttggtggttccaggattttactcagaatgacgttaggaagagaagtgatgtctcctcttcaggcaatgtcttcctatactgtggctggcagaaatgttttaagatgggatctttcaccagagcaaattaaaacaagaactgaggagctcattgtgcagaccaaacaggtgtacgatgctgttggaatgctcggtattgaggaagtaacttacgagaactgtctgcaggcactggcagatgtagaagtaaagtatatagtggaaaggaccatgctagactttccccagcatgtatcctctgacaaagaagtacgagcagcaagtacagaagcagacaaaagactttctcgttttgatattgagatgagcatgagaggagatatatttgagagaattgttcatttacaggaaacctgtgatctggggaagataaaacctgaggccagacgatacttggaaaagtcaattaaaatggggaaaagaaatgggctccatcttcctgaacaagtacagaatgaaatcaaatcaatgaagaaaagaatgagtgagctatgtattgattttaacaaaaacctcaatgaggatgataccttccttgtattttccaaggctgaacttggtgctcttcctgatgatttcattgacagtttaaaaaagacagatgatgacaagtataaaattaccttaaaatatccacactatttccctgtcatgaaaaaatgttgtatccctgaaaccagaagaaggatggaaatggcttttaatacaaggtgcaaagaggaaaacaccataattttgcagcagctactcccactgcgaaccaaggtggccaaactactcggttatagcacacatgctgacttcgtccttgaaatgaacactgcaaagagcacaagccgcgtaacagcctttctagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaagggaaggaaaatacaatcatgcggcctgcttcggtctccagcctggctgccttctgcctgatggaagccggatgatggcagtggctgccctcgtggtgaacttctcacagccagtggcaggtcgtccctctctcctgagacacgacgaggtgaggacttactttcatgagtttggtcacgtgatgcatcagatttgtgcacagactgattttgcacgatttagcggaacaaatgtggaaactgactttgtagaggtgccatcgcaaatgcttgaaaattgggtgtgggacgtcgattccctccgaagattgtcaaaacattataaagatggaagccctattgcagacgatctgcttgaaaaacttgatgcttctaggctggtcaacacaggtcttctgaccctgcgccagattgttttgagcaaagttgatcagtctcttcataccaacacatcgctggatgctgcaagtgaatatgccaaatactgctcagaaatattaggagttgcagctactccaggcacaaatatgccagctacctttggacatttggcagggggatacgatggccaatattatggatatctttggagtgaagtattttccatggatatgttttacagctgttttaaaaaagaagggataatgaatccggaggttggaatgaaatacagaaacctaatcctgaaacctgggggatctctggacggcatggacatgctccacaatttcttgaaacgtgagccaaaccaaaaagcgttcctaatgagtagaggcctgcatgctccgtgaactggggatctttggtagccgtccatgtctggaggacaagtcgacatcaccatgtgttactggcctggaaactgaagggagttttgcaagtgaaaatttagatttctattgacatccttttgttttctaattttaaaaattataaagatgtaaatggaattataaatactgtgacctaagaaaagacccactagaaagtaattgtactataaaatttcataaaactggatttgatttctttttatgaaagtttcatatgaatgtaacttgattttttactattataatctagataatatgatataagagggctaagaatttttaaattgaatcatatatatgatataatttgatccttcttgtatcttgaagttttgtacttgggatttctggactgataaatgaatcatcacaaaaaaaaaaaaa

SEQ ID NO: 820 - DNA, 4149 bp, Homo sapiens
  CDS (43)..(3894)
agcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtacgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggttggtcgtgaagcccactccctccaacacctccggggcctctcccctctcactgctgccctccacacccagagaacctccacagactccagccctccgacacctgcacagatccatctcccaagacaccacccaaagagagcatttgctgctgcttcccagaactgtccaacataccttagcagcc

SEQ ID NO: 821 - DNA, 998 bp, Homo sapiens
  CDS (109)..(693)
ggcggaattcgaagggcctcctccctctccagtgtggtgactgggctgaggagattctgggactgatagtgtcatggtggagcctccgtccctgctcatcctctccgcatgttgcttctgctcccgatggctctctctgaaatgcagcacaacctcctaggccaatggaagaaggcccagagctggctccctgcctggaagcacgaggagacccgcacaggcatcctgagaaggcgtggagagcaggctgccttcatggggggagtgccagggcctgggcacccacacccgctgacccaagagggcccgggcacctgcgtgctggcctcttcactgaccttcgctctgtctgctctctttgtgtctctctctgacctccagaggcctcctttctctctgccaggaacagtagcccccctgcaaggccctccttttcctccagcccgcagcctgcggcctctccggttctgctccacagcccggctgccacacactcgcctctctctccaggccccccgggttccctccgcctctcttgctgcctgttctctccttttgcaggttgcgtttattggcttatctctgggggttggtgctctcccttgtttccatggaaactgcctggccccaggaggcccaagcagctttgagctccaagggcaggaccatgcaggccatcgctgccctgccgcttagccacagggcacgatttctgactcggtttattagagacatagtgtggcagtctctagaccccacagtcgggctggcatctggggacaggaccaacacccccacaccccagaggcgaactgtggtgagtgtaaagagcccctctccaagggaagacagccggtcagagtgcggtgtgctgtgctggagagcacagccccaggcgtgacaaacacctcggcctcttagaagttgtcccttatctggacaggaagtctggaggctgaaacagagactcccaccttcccagagtctcctgggcagtg

SEQ ID NO: 822 - DNA, 1966 bp, Homo sapiens
  CDS (196)..(1653)
ttcgtagtccactagcccagggcggggaattcgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaa

SEQ ID NO: 823 - DNA, 297 bp, Homo sapiens
  CDS (21)..(272)
aaaaagcataatgacattagatggcggccttatgctgttgtctctggaagatctccggctgtgaggaagtccctctaacttacaacctgctcaagagcctcctagataaagcgcactgtgtactcctgacaccttgtgggtacatcttttccttgatcagtccagaaattctcaaactcactttaatcactttgcagatcctcttaatactcaaaaatctacacttactgtggctgacagtttcaagcagatgtgttcatcgcagtagtgcatgaaaagaaaagtagaagaaccctg

SEQ ID NO: 824 - DNA, 2810 bp, Homo sapiens
  CDS (541)..(2136)
aaggatccttaattaaattaatcccccccccccgcggggtcctcttgtagcggccacgttgatctgcgatacgcgtgtttgcccagtgagtggccccggactgctacgtgggactgcggtgaatgaacccagaaggtggagaggaaccgttctcggtgcacagaggcggctctgcagcccggtgagggcgcctgctgctcccgggcagtgctttccccaagtagtccgatggctgcggctgcgccgaagcgccctactcaggagcaacttggcgaggttcagactcttggagccagaagctacatgacccctaaacgggcacagtgacttttgaagacgtggctgtgaaatttacccaggaggaatggaatctccttagtgaggctcagagatgcctgtaccgtgatgtgactctggagaacctggcacttatgtcctccctggcagggcactgtgacctttgaagatgtggctgtgaacttttcccaggaggagtggtgtcttcttagtgaggctcagaggtgcttgtaccgtgatgtgatgctagagaacctggctctcatatcctcgctgggttgttggtgtggatcaaaagatgaggaggcaccttgtaagcagagaatttctgtacaaagagagtctcagagcaggactcctagggcaggtgtttctcctaagaaggctcacccctgtgaaatgtgtggcctcatcttggaggatgtttttcactttgctgaccaccaggaaactcatcacaagcagaagctgaacaggagtggagcatgtggaaaaaacttggatgacactgcataccttcatcagcaccagaagcagcatattggagagaaattctacagaaagagtgtcagagaagcatcgtttgtaaagaaacgtaagctcagggtgtcacaggagccatttgtcttccgcgagtttgggaaggacgttctgcccagttcaggattgtgccaagaagcagctgctgtagagaagacagacagtgaaactatgcatggcccaccctttcaggagggaaaaactaattacagttgtggaaaacgcacaaaagccttcagcaccaaacactcagttattccacaccagaaacttttcactagagatggatgttatgtgtgcagtgattgtggaaaatcctttagcagatatgtcagcttcagtaatcatcagcgagatcacactgcaaaaggaccttatgattgtggagagtgtgggaaatcttatagtcgaaagagcagccttattcaacatcagcgagtccacactggacagacagcttatccctgtgaggagtgcgggaaatcttttagtcagaagggcagccttattagccatcagcttgttcacactggagaaaggccttatgagtgtagagaatatgggaaatcttttggtcaaaagggtaacctcattcaacatcagcaaggtcacactggagagagagcttatcactgtggggaatgtgggaaatcttttcgtcagaagttctgctttattaaccatcagcgtgttcacactggagaaaggccttacaagtgtggagaatgtgggaaatcttttggtcaaaagggcaacctcgttcaccatcagcgaggtcatactggagaaaggccctatgagtgcaaggaatgtgggaaatcatttaggtacagatcccacctcactgaacaccagagacttcacactggggaaagaccttacaattgtagggaatgtgggaaattatttaacaggaagtatcatcttctggttcatgagagagttcacactggagaaaggccatatgcgtgtgaggtatgtgggaaattatttggcaataagcgcagcgtgactatacatcagaggattcacactggagaaaggccgtatgaatgcagtgaatgtgggaaatcatttctttccagctctgcgcttcatgttcataaaagagttcattctggacaaaagccttataagtgcagtgaatgtggaaaatccttttctgaatgttccagtctcattaaacacaggagaattcacactggagaaaggccttatgaatgcaccaaatgtggaaaaacatttcagcgaagctctaccctccttcatcatcagagttcacacaggagaaaggccttatgagtgcagtgaatatgggaaatcgtttgctgaagcatcccgtctcgttaaacacaggagagttcatactggagaaaggccttacaatggtagggaatgtgggaaattatttaacaggaagtatcatcttctcgttcatgagagagttcacactggagaaaggccatatgcgtgtgaggtatgtgggaaattatttggcaataagcacagcgtgactatacatacagaggattcacactgagagaaaggaccgtatgaagtgcagtgaatgtgggaaatcatttctttccggctctgcgcttcatgttcataaaagagtgcattctggacaaaagccttataagtgcatgtgaatgtggaaaatccttttctgaatgttccagtctcattaaacacaggagaattcacactggagacaggccttatgaatgcaccaaatgtggaacaacatttcagcgaagctctagcctccttcatcatcagagttcacacaggagaaaggccttatgagtgcagtgaatatggggaacatcgtatgctgaaacatcccgtctcgttaaacacaggagagttcatactggagaaaggacttatgagtgctgtcaatctgggaaacatcagaatgtctgctctccttggtcttaagagacttcgcattggaacggagtctcatt

SEQ ID NO: 825 - DNA, 891 bp, Homo sapiens
  CDS (157)..(552)
cccacgcgtccggttctacacattccttagagattggatggggtgcatcaggatgggttatgattacttttcttcttgcctcagcctttcagtgccacagaccccaaggccatcggccatcggaactaccatgcaggtgggtggatgggcgtatgaatgccaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcaaaaccccagcctctttgtaaagattctcatcgtggagatctttggcagcgccattggcctctttggggtcatcgtcgcaattcttcagacctccagagtgaagatgggtgactagatgatatgtgtaggtgaggccgtgctcactattatgtattgctggttttcctgggacagctagagctgtgtcccttagcctttcagaggctatggtattcaggtgcctccctgcactcgactcttgctacgtgtagatttggatgcactgcagtccaggacgaatactcagtgcggcgaacaggctgctgcagctgactcttgtcaactggcatctgtgttcccagctcagccttaaacgatctcaaagtgtttgtgaataaacatggaattttctggtcaaaaataattagtcaagggggtgcgaaacttattccgtaatgagggtaattttaac

SEQ ID NO: 826 - DNA, 1381 bp, Homo sapiens
  CDS (238)..(1278)
cctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttggaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatcccttaaaaaaaaaaaaaa

SEQ ID NO: 827 - DNA, 2518 bp, Homo sapiens
  CDS (24)..(2171)
cagcccccccgtggctgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccaa

SEQ ID NO: 828 - DNA, 2109 bp, Homo sapiens
  CDS (169)..(621)
gtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataaggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttctcaacttgacagtctacctgtggtataactgtcaggtaaaaacatacatctttacaacttggtggtcccaagttaaaaaaaaaaaa

SEQ ID NO: 829 - DNA, 2336 bp, Homo sapiens
  CDS (15)..(1712)
ggcacgaggtggagatggatgcggcagacaggagctgcacagtgtctgtgcactgcagcaaccatcgtgtcaagatgctggtgaagttccctgcacagtacccaaacaacgccgccccttccttccagtttattaaccccacaaccatcacatccaccatgaaagctaagctgctgaagatcctgaaggacacagccctgcagaaagtgaagcgtggccagagctgcctggagccctgcctgcgccagctcgtctcctgccttgagtcctttgtgaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggttacctggtatatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcggaaatcaagacgatggaaaagtaagcgtgagggatcagactctggcaatcgacagatcaaggctgctgggaaagtcatcatccaggatattgcttgcctcctgcctgttcacaaatcgctgggagagctgtacatattgaatgtgaatgatattcaggaaacatgtcagaagaatgccgcctctgccttgctcgttggaagaaaggatcttgtccaggtttggtcgctggctacggtagctacagatctttgccttggtccgaaatctgacccagatttggaaacaccctgggctcgacatccatttgggcggcagctgctggagtccctgttggctcactattgccggctccgggatgttcagacactggcgatgctctgtagcgtgtttgaagcccagtctcggcctcaggggctaccaaacccctttgggccttttcctaaccgttcttctaatcttgtggtgtcccatagtcgatatcctagctttacctcttctggttcctgctccagtatgtcagacccagggctcaacactggcggctggaacatagcgggaagagaggcagagcacttgtcctccccttggggagaatcctcaccagaagagctccgctttgggagtctgacctacagtgatccccgtgagcgagaacgcgaccagcatgataaaaataaaaggctcctggaccccgccaatacccagcaatttgatgactttaagaaatgctatggggaaatcctctaccgttggggtctgagagagaagcgagctgaagtgttgaagtttgtctcctgtcctcctgaccctcacaaagggatcgagttcggcgtgtactgcagccactgccggagtgaggtccgtggcacgcagtgtgccatctgcaaaggcttcacgttccagtgtgccatctgtcacgtggctgtgcggggatcgtccaatttctgcctgacctgtgggcacggtggccacaccagccacatgatggagtggtttcggacccaggaggtgtgtcccaccgggtgtgggtgccactgcctgcttgaaagcactttctgaacctacagaagttgggtattgtctgaaatcccagaggacccataagtgccggtgacaagctgtctgtcaggggagaggctccagaacctgggttcgtccccagtgagaccggaggatgatcccccaaggactgcgcagcatcagctcttggtgggcctctgccttctcttctgtttggccacctggtgtggatgtcactgtgtgaagataaggacagaagtgcagagctgcgctttgtgtgttgtctatgtcggctgagctaccaaggtggaagttttcatggagaaaagcacctggctccagggccagtgttacagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaaattctagtaatttgaaaaaaaaaaaaa

SEQ ID NO: 830 - DNA, 1215 bp, Homo sapiens
  CDS (1015)..(1167)
gttcaacttcgatttaagtcctagggcctgacaaagtgaccctggataaatgtcatctccagccatctgttttctttagttctcattacatctgtccaggctcttctatcagcatcaatcctttcctgcagggacggaagagttttcaaatccttgctgaaagcattttgttctcctctgtaacagcacagggcatgaaattgtttggagtctttttatcaaattctctatagactacatgatccgtgccaataccacagcagtcagcagctgttgtctgtgctaggagaccacagtagtaattacacacaggttaagtggcttaaaaaaattgatcggttttgaaaattaggtgtggaagatagaaaggaacctgaggatttttataatatttttgtgatataatagactatagccaaaagagttactttatagtgagtatttttagcttcagtcccacattctcttcagaaattagtattataatccttttcattactctaaccgagtctgatgactcctgtcctaggatgaaacacccctcccaactcccttattaagagattgggaccttagtgtgattaacagcaccctgatcgatgagcaagatttcttacagattaaggaaaagaattgctgacaacttaggctgacctttatatacctatttgttttccttcctaattcctcttaaaatgaaaatgccaagattttcttttgatatttgttacatttgtgaaataatataacaatgcagttaatgggaagagcatgacccctggattcagatatccaatagttacaaatctcagcttcagcacctagcagttatgtgaactttcttctctgcacctcagtctcttcataataactactttgcagagttgctgtgaatattagtgtaaataatggacattcaaatatagctattactgttattatcatcatcaattattctacctatagaaatatgcaagttccttggaagtatacatttctggagagtgatcagggatgggatattatacttttattttttcggtttctcttcattcattcagtgggttatgggtatgtgtgtgtgtgtgtgtgtgtttcacacattatgtgctaggcactatttcaggcacttggaacgtacattattgtaggggtacaactggaaactgataaatgctgtaaaaaaaattaaacaagctaagaggtacaggaggt

SEQ ID NO: 831 - DNA, 2904 bp, Homo sapiens
  CDS (1)..(2595)
  misc_feature (1)...(2904): n = a,t,c or g
atggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggcagaggaagccacggccactggaccctggcgaaggttccaaggacacagacagttcagcagggcgacggggcagcacaggcagaaggcatgggcgctggcggggccgtgctgagagcccaggagtgcccgtggccaaggtggtacgggcagtaaccagccggcagagagccagccggcgggtcccacctgccccacctccggaagccccaggccgccagaacctgagtggggcagcagctggggaggcgctggtaggggcagctggcttcccaccacacggagatacagggagcgtggagggcgccccccagcccacggacaatggcttcacccccaagtgcgagatcgtgggcaaggacgcactgtctgcactggcccgggccagcaccaagcagtgccagcaggagatcgccaatgtggtgtgcctgcaccaggctgggagcctcatgcccaaggctgtgccccggcactgtcagctgactgggaagatgagccccggcatccagtgggatgagagccaagcccagcagcccatggatggccccccggtgcgaatcgcctacatgctggtggttcacggccgcgccatccgccagctgaagcgtctcctcaaggccgtttatcacgagcagcacttcttttacatccatgtggacaagcgttccgactacctgcaccgggaggtggtggagctggcccagggctatgataacgtgcgggtgacgccctggcgcatggttaccatctggggcggggccagcctcctgacgatgtacctgcggagcatgcgggacctgctagaggtgcctggctgggcctgggacttcttcatcaacctcagtgccactgactatccaaccaggaccaatgaggagctggtggcattcctatccaagaaccgggacaagaatttcctcaagtcacatggccgggacaactccaggttcatcaagaaacagggcctggaccggctcttccatgagtgcgactcacacatgtggcgcctgggcgagcggcagatcccagcaggcattgtggtggatggcggttctgactggttcgtgctgacacgcagctttgtggagtatgtggtgtacacagatgacccgcttgtggcccagctgcgccagttctacacatacacactgctcccagccgagtccttcttccacacggtgctggagaacagcctggcctgtgagaccctcgtggacaacaacctgcgggtcaccaactggaaccgcaagctgggctgcaagtgccagtacaagcacattgtggactggtgtggctgctcccccaacgacttcaagccacaggacttcctccggctgcagcaagtctccagacccaccttcttcgcccggaagttcgagtcgactgtgaaccaggaggtgctggaaatcctggacttccacctgtatggcagctacccccccggcacgccagccctcaaggcctactgggagaacacctacgacgcggctgatggccccagtgggctcagtgatgtcatgctcactgcttacacagccttcgcccgcctcagcctgcaccatgccgccactgctgcacccccaatgggcaccccactctgcaggtttgagcccaggggcttgccgtccagcgtgcacctgtatttctatgacgaccatttccagggctacctggtgacgcaggcggtgcagccctcagcccaggggccggcagagacgcttgagatgtggctgatgccccaagggtcgctgaagctgttggggcgcagtgaccaggccagccggctccagagtctggaggttggcactgattgggaccccaaagagcgtcttttccggaactttggggggttactggggccgctggacgagcctgtggccgtgcagcgctgggcccggggccccaacctcacagccacagtggtctggatcgacccaacctatgtggtggccacatcttatgacatcacagtagatacggagactgaggtcacgcaatacaagcccccactgagccggcccctgcggccagggccctggactgttcgactccttcagttctgggaaccgctgggtgagacccgcttccttgtgctgcccttgaccttcaaccgcaaactacctctcaggaaagatgatgccagctggctgcacgcagggccaccccacaacgagtacatggagcagagtttccagggcctgagtagcatcctgaacctgcctcagccggagctcgcggaggaggctgcccagcggcacacacagctcacaggccctgcgctcgaggcctggacagacagggaactgagcagcttctggtccgtggctggactgtgtgccataggcccctctccctgcccctccctggagccctgcagactgaccagctggagctctctgtcccccgaccccaaatcagagctggggcctgtcaaagcagacgggcgactcaggtagcagggccccagccagtacccgtggaggacccgggaaattgcaccttacagacagtggaggggtgtcccctcccacaggcaagaaccagagggccaggctgcacaccatttcagccatccagagccacacagacggcagggaaagtggacacagtatgaactactgctgatgtctctgttngggatcagaggctggcgggaccgagaagggcacagcagattcacaccagtcttctcacttcctgctagttgaattgcttttcttttcgtttgttgtttaattaaaaaggaaatgggtgtggagaac

SEQ ID NO: 832 - DNA, 1096 bp, Homo sapiens
  CDS (2)..(1054)
gatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaactgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaaaaaaaaaaa

SEQ ID NO: 833 - DNA, 2225 bp, Homo sapiens
  CDS (115)..(1896)
  misc_feature (1)...(2225): n = a,t,c or g
gaccgcgctggaattnnncgtcgacccacgcgtccgctccaagaccagcctcctggggggaccaggcacccggccttcactggcacccagggagccgtcctcagcagcgtcaacatgtcaaggcccagcagcagagccatttacttgcaccggaaggagtactcccagaacctcacctcagagcccaccctcctgcagcacagggtggagcacttgatgacatgcaagcaggggagtcagagagtccaggggcccgaggatgccttgcagaagctgttcgagatggatgcacagggccgggtgtggagccaagacttgatcctgcaggtcagggacggctggctgcagctgctggacattgagaccaaggaggagctggactcttaccgcctagacagcatccaggccatgaatgtggcgctcaacacatgttcctacaactccatcctgtccatcaccgtgcaggagccgggcctgccaggcactagcactctgctcttccagtgccaggaagtgggggcagagcgactgaagaccagcctgcagaaggctctggaggaagagctggagcaaagcagacctcgacttggaggccttcagccaggccaggacagatggagggggcctgctatggaaaggccgctccctatggagcaggcacgctatctggagccggggatccctccagaacagccccaccagaggaccctagagcacagcctcccaccatccccaaggcccctgccacgccacaccagtgcccgagaaccaagtgcctttactctgcctcctccaaggcggtcctcttcccccgaggacccagagagggacgaggaagtgctgaaccatgtcctaagggacattgagctgttcatgggaaagctggagaaggcccaggcaaagaccagcaggaagaagaaatttgggaaaaaaaacaaggaccagggaggtctcacccaggcacagtacattgactgcttccagaagatcaagcacagcttcaacctcctgggaaggctggccacctggctgaaggagacaagtgcccctgagctcgtacacatcctcttcaagtccctgaacttcatcctggccaggtgccctgaggctggcctagcagcccaagtgatctcacccctcctcacccctaaagctatcaacctgctacagtcctgtctaagcccacctgagagtaacctttggatggggttgggcccagcctggaccactagccgggccgactggacaggcgatgagcccctgccctaccaacccacattctcagatgactggcaacttccagagccctccagccaagcacccttaggataccaggaccctgtttcccttcggcggggaagtcataggttagggagcacctcacactttcctcaggagaagacacacaaccatgaccctcagcctggggaccccaactccaggccctccagccccaaacctgcccagccagccctgaaaatgcaagtcttgtacgagtttgaagctaggaacccacgggaactgactgtggtccagggagagaagctggaggttctggaccacagcaagcggtggtggctggtgaagaatgaggcgggacggagcggctacattccaagcaacatcctggagcccctacagccggggacccctgggacccagggccagtcaccctctcgggttccaatgcttcgacttagctcgaggcctgaagaggtcacagactggctgcaggcagagaacttctccactgccacggtgaggacacttgggtccctgacggggagccagctacttcgcataagacctggggagctacagatgctatgtccacaggaggccccacgaatcctgtcccggctggaggctgtcagaaggatgctggggataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctaggcttgtcaagaatctgttcagtccctctccttctcaataaaagcatcttcaagcttgtaaaaaaaaaaaaaaa

SEQ ID NO: 834 - DNA, 2023 bp, Homo sapiens
  CDS (153)..(1775)
ggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataaggccacgggaagaatctctggcagaaaagaagtacacctctcaagggcagggggacttagacagtgtgctctcccagttgaattttacccatactagtgaggaccttctgcaggcagaggtgacttgtcttgaaggcagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagaaaaaaaaaaaaaa

SEQ ID NO: 835 - DNA, 12078 bp, Homo sapiens
  CDS (1)..(12075)
atgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacaggtgaggcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactga

SEQ ID NO: 836 - DNA, 2018 bp, Homo sapiens
  CDS (425)..(1501)
agagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacgttctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataaaaaaaaaaaa

SEQ ID NO: 837 - DNA, 1645 bp, Homo sapiens
  CDS (338)..(1147)
aattccaccactcctcccaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaa

SEQ ID NO: 838 - DNA, 936 bp, Homo sapiens
  CDS (505)..(801)
ccctcctgtactaggaggattgaagaggagtaattttctcgccatgcaactcagtgcgtagcctggggactgtctccactgctacggttgtggggtggggtctgcagtctgcactcgaggtcagcatgtcatactcagcctccccaggactgagatgggaacaagagaggcccaagtggctggcaggagaccaagctcctcaagcaaagcccagctctctggcctgtctttggcgggtgagcttttattatgtgcatagcagagaactttggaaacaccatcttccagtggtgggatctcttctctctctccttgtaggaatcaacgctgaatgtggacttggatttcaagcagcctttcctagagttgaatcgaatcctggaagccctgcacgaacaagacctgggtcctgcgttggagtaaggaggcccttgggtgggccagcagcactctgcttcgacctctcagggcacagggcttgactgtggtcttcatttcacccagatgtacttgacttgcctgcagccctgtctcaagagcctcacacaggcttttggggccctcctctcaggtgctggctctcaggtcctagcccccaccagctctacactaaactggcccctttcttcccagatgggccgtctcccacaggcagcgcctgctggaactcaacagctccctggagttcaagctgcaccgactgcacttcatccgcctcttggcaggaggccccgcgaagcagctggaggccctcagctatgctcggcacttccagccctttgctcggctgcaccagcggggtgagtgcccaggcagctggggttgtgctgcctggcctgacacatgtctggatgtggtaggttacatcaggctgccagtccctgcacccatgtggggctgtctgttacacagatgcctctccccaactagaaactt

SEQ ID NO: 839 - DNA, 804 bp, Homo sapiens
  CDS (545)..(775)
ggagtgatgggtggcatcacgggaatgtaggaacccgcaacgatgcagcacgaccatgcctgtccggggcgttataacatgcaagggtgagcgcagctctgtgcgggatacattagacagactccatcgtgaccaggtccgacctgtctgcctttagtgtcctttcccggccgatatcgcaggaaacccccgactctatcgacagcgggaaagaggctctgagactggagaggaaaccacggacctgcagggcccgcctcgcctctccgctaagccaagtggtgttcccaacttgcttcgacttgcttccgtgcgctcaggtcgcctgcccggtccagcagtggcgtatgatgcgcaggatggagcgcgcatgcgcactggccgccagccgaggacggaagtgggcgtccggaagctagacgtgtcccctgggcgtgacttggcactgccgcgtcgcagttgccgcattcgccgcattcgctgcaggcgcgagcgggctgccactgccgcagcagccgagcccaagtctgagggcgttgtggctatgactttcaagatttttctcctttttgcagggcttatggttaaagttcctgtggggttatatttttcctgcaaattacttcttttccaaagtctgatgttgatgtcccctgaagacagcggcttttatgcgaccattgttgcagtggtcgggcttcatgtggtgctggcaattttcgtcttcatagtgtggaaggagggcttgccccagtggcgggaaaacaaaaacgaatagagcagcttcttcagagctgcagacgt

SEQ ID NO: 840 - DNA, 2816 bp, Homo sapiens; identical to SEQ ID NO: 359
  CDS (228)..(2813)

SEQ ID NO: 841 - DNA, 709 bp, Homo sapiens
  CDS (225)..(509)
tgatcttccgtcccaaaataaattaataaataaaaaaaataaaaatcaaataaagaaaaacaaaatcaataaacaaagaaagtggtttccgctgtgccctctgaaacttaaagtctcttactgacttttctaaacctaagtgtctccatccatagtgggggataccaaggccatggtcacaccctgatgtgactgtctcatgaggaaatgatgggaattcctttatgactctgcagtggtccctccgtgtctgctggagggggtcctggctgattcccagctctacatcctgtagattctcacacccagggcctccttcggcctcttctcaggggagtctcagagcaggagcctctctcccttgcccagtgaaagtcattctcccctctcccatccacctcacccgcggccacaatcctgagacttccccccgggaggcacacttctcctccctgccctgctgctcccacggaaaccctgtcctgcttctcacactgacatctgctctctaatcacagaggatcctgtcattaaaagattcttggcctgggacaaagatctgagggtgtcggacaaggtaaggttgttctccatgtaactgttcctgttccaacgcatggctggggggagggcgcagcttccaaacccacagttctccctccaccacctcccaccagatgctcctacagtctttttgtgtgtgtgtgtg

SEQ ID NO: 842 - DNA, 2960 bp, Homo sapiens
  CDS (229)..(1860)
tcgacccacgcgtccggcagcatcgcttgtcctgagctggttgccggggcaggggtttaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatgaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgccagagtgaaaaaaaaaaacacgacacacacacaaccaaacaacacttttggggcgcgccgcgcgcccccgggaagaagcgctcacacaaccacccggggggcgccggggcccccagcgggacgggcgaaccggggccacgggggccccaaggaacaccgggcccgcgaacagcgggggggtcccccccaaaaaaagccggggggaaccagcgcgccggaccacccagacgcg

SEQ ID NO: 843 - DNA, 1291 bp, Homo sapiens
  CDS (12)..(812)
ccaacatcagaatggggccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgctgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcaaaaaaaaaaaaa

SEQ ID NO: 844 - DNA, 1248 bp, Homo sapiens
  CDS (183)..(539)
attctcgggtcgacgatttcgttaggcacccaacgtggccttctttgttcctgggctcagtgcactctgagtgcgggttcgtgatgactagtcttcagtctcgacagtaaggtctctgggtacactttttccaatgctcccctcttttcaggtttgttgactggtaatattccagggttattatgggacaattgcagtttaaacaccaggcttatctgtcttttattaaacttcttcttaaacagggtagaatcaaggctgattccaataaccttattctcttatttcagactattgaaaaacattgtccttggttccctgacaaagattctatggacctgttagactgggatagagttggcgccactctccgccaactcatgagagttggtgtttttcatcctatttctgtttggactgactgggctcttattcgtgttgctttacttccttttcagtctggtgatactcttcaaatgccagaagttaaggtggttggtgaaccattccctttaccttgggtagctgaccccccctactagtcctccttctgatgatgaagaagaattcgatctctccttgttttctccccaagaggaggaacctggtgttgatcccctccctccacctcctatcttggaacctgtatatattaactcttcttctaccaagccgttgtcccctctgccagaggaggatgtgtggcattcatctgaatcggctgtttctcattcctctcatccttttggacctctcccctcttctaagcctactgtttcttttgaggctccaggaccccttatttcagagactaatctggctgacttcgttggcactattgataatcatttacctaagtcaaaattctttcaatttctaagaaatacttcctggattctaccaaaacttacacattcatcaccaccagagacagccgttaccatttttactgatggatcaagtaatggaaaggcaggacacctgaaattatgtcctgaaaatgcatacaacaacaagacagagaaatttgctgaaaaagcaccacagcaagaaacaactaacacatccaatcatcaaaaagaagaaagtgaccatgctaactcctttacaacagacaatccagtcagccatcctgaacaacttgtctctgcagatccagatcccaggacccctaactataccaccagcttttctgagtttccaggttgcctattgcagattgtgggacttctcaactttcatactcat

SEQ ID NO: 845 - DNA, 2128 bp, Homo sapiens
  CDS (163)..(627)
aactgcgggcggcgcagggcaggggcagtcagggagcagcggcggcagagacagggccgggcgggcgccgcctgcggagagcaccgggaggcgggccctgcgtggggccgcgcgcagcagcggcgacgactttatctgggccgcgggggacagcgcagggccatggaggaggcggccgcagctccgatttctccgtggacgatggcagccacgattcaggccatggagaggaagattgaatcgcaggctgctcacctgctttccctagaaggtcaaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcacaacaggaacttctggatcctgcggctgcccccgggcagcaagggggagtcccctaagactacgccatctccaagtccgaggtcctctcccagattgaacaagggaaggagccctgcaactggcgccgccctgaccccaagattccagatgttcctgtggaccccagtccagatgcagaaactgaggcccagcagagattgagtaacttatgcgagttgtcactcacctcacacgccccagcaagcatccaggagagcctgcctcttggaatagaaatcagacatcccacaggaactctgaggttttcccactgctgccagatgtatgcaaggaacacgtgatcttcgtaattccagagcggggcaaactgcttggcacctcttcaataggtgacattcaatgatagatctctggcttcctgctctgtttgttctggttgccctggaaagcctgctgctcagcccatgccccgggacttcctccaccctcaccaggacattctttccatctcttgtctcctgtgtgcaagtccctttctcctggattccatgtcttgaatgtttcttaatttacttcctcattttggcagaggatgtcctccagttgttttctgggaatgctaatatgcaagtgaaccagtgacctgcagttctgcccacacagggttaataaccaatcagattctctcttttcaagatggttaacataacagacaccaagaaagggaagaggagccgacagcagagggggaagctgaaaagacgcacaaagaatggccataaaagatatgagcaaccccagctttccagacagtcacttttcccagtggtcatacctggtctggaagattccccatcatctcgaataaagctgttgttgcttttaactccatggagagaccgaatggagtgagcccagcagggcatgctgggcaagagaggtcccccgagtcccaaataagaatttcaactagtataaaacgaggcagcgaacccacacgtggaagtctgataccgcttgcagaagggaattgaatagatgtctccctattggtaaggatgtggttttattgacttgaaataacaaagcccgcaagcaacaactgatcatccgcgggatgctgccacaaggaataattgagcactcattcagacacaggggaaaccactgcctctttcagtctttctcccagattccaacagtcagtgttacagcatttcaccttgttcacctccctgagaagacgttgcagctcactcaccccagtgggcactgggagcctctgctcaggtgggagacagatgccccccacacgcacatctggtgtttatgaagcagatactggggcttcataaacacagaaggggcagggaagtagccccagggcatagtgtggggcctcctgactaaaagtagcttgcaaacccctgcctataacagccacttcctggcggtcattgtgccacttaggagccctcctcaccgctcttcctttagttccttcactctgtatagaccctgccagagcagctcagggtggagcagctgcagccatgggacctgctccaggcaaggccctatgctacacagtccctgggggtgaggattccagaggagtcaattccctacccgcccttccaggggatggccgagatgagcgttcccacagggaaagtgaaagttgcaaggctgttgcgga

SEQ ID NO: 846 - DNA, 1444 bp, Homo sapiens
  CDS (99)..(1187)
tttcgtctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaaggactttttcacagggtacctttagtggttgccaatctgggcatgtctgaacaactgggttataaaactgtatcaggttcctgtatgtccactggttttagccgagcagtacaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaaaccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacatttcgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacaacacattctttagaa

SEQ ID NO: 847 - DNA, 1581 bp, Homo sapiens
  CDS (212)..(1324)
tttttacaaaagagaggatttccttttctataaactgttttagacgcgttttagattaatgaagttgtgaagttaggtctcctgaagcctgagctgacggcagcacgaagggtaagagcaggtgttcttgggctttgtgttgaccagcttgccttacacaaccccagcactgtctgggacacggaaggtgttcttcttaaggaagtaaaagatgaaggcaagaatagcattactgattcccaaatggatgatgttgaagttgtttatacaattgacattcagaaatatattccatgctttttttagcttttataattcctcaagtgaagtaaatgagcaagcactgaagaaaatattctccaatgtcaaaaagaatgtgataggttggtacaaattctgtcgtcattcagatcagatcatgacgtttagagagaggctgcttcacaaaaacttgcaggagcatttttcaaaccaagaacttatttttctgctattaacaccaagtataataacagaaagctgcgctactcatcgactgaaacatgccttgaaacctcaaagaggactttttcacagggtacctttagtggttgccaatctggatatttctgaacaactaggttataaaactgtatcaggttcctctacatccactggttttagccaagcagtaaaaacacacagctctaaattttttgaagaagatggatccttaaaggaggtacataagataaatgaaatgtatgcttcattacaagaggaattaaagagtatatgcaaaaaagtggaagacagtgaacaagcagtagataaactagtaaaggatgtaaacagattaaaacgagaaattgagaaaaggagaggagcacagattcaggcagcaagagagaagaacatccaaaaagaccctcaggagaacatttttctttgtcaggcattacggaccttttttccaaattctgaatttcttcattcatgtgttatgtctttaaaaaatagacatgtttctaaaagtagctgtaactacaaccaccatctcgatgtagtagacaatctgaccttaatggtagaacacactgacattcctgaagctagtccagctagtacaccacaaatcattaagcataaaaccttagacttagatgacagatggcaattcaagagatctcggttgttagatacacaagacaaacgatctaaagcagatactggtagtagtaaccaagataaagcatccaaaatgagcagcccagaaacagatgaagaaattgaaaagatgaagggttttggtgaatattcacggtctcctacatttcgatccttttaaccttacaaggagatttttttatttggctgatgggtaaagccaaacatttctattgtttttactatgttgagctacttgcagtaagttcatttgtttttactatgttcacctgtttgcagtaatacacagataactcttagtgcatttacttcacaaagtactttttcaaacatcagatgcttttatttccaaacctttttttcacctttcactaagttgttgaggggaaggcttacacaacacattctttagaa

SEQ ID NO: 848 - DNA, 916 bp, Homo sapiens
  CDS (151)..(507)
acatgccctcaattctagaccatctcaatgttctcaagaaggctttgagacccacatacctttgggaaaatgttcccttttctgaattcatagcaattaccgtctgtatcacttctttggaattaattatgtacaagcagaccccaaattatggcaggcttgtcattgaaaagtttacttgtactttcattgtttagaacttggaataaatggtggttggatttccagctggcccatggaagcctctttaacctacaatgtattattagtcctgtcgtcgttcctcattgttttcaaggaaaacgtgtcctgacttccaagctggactttgggaagctgggaagagatctttctctggagctcaagcctctgggggtgccatgtgacttggcatgtccccttctctcctctctgactcacaaggagacattgtcactctcaggaatgacaagaagagcatccctgggcatcaccaaagccaaaagaaatatcacgtgtgaaattcaatgattgtggttgtttctcaaaaacaggtattcagtaggcatttgtaactccgaagcttcctgtacttaaaccgtgacaaagcttatatgtttatattaagcttttaatattttatgactgtcttcatggtttatgttcctggtgtatgggaaccatatctcagtttctttgtatgcagcaaatcctccagtccacagctaagcacataagagcagctcaataaacatttattgatccataattacagctacatgaaaaagcaattcagacaagagctgaatcagtcaagcactattaggcatcaaaacagataacgtaatgatttcacgcatacctggcttagctgtcttatcttcagtcttatagctcagatgcagttttaaaacgaaatcgtgacaggaagacgaaa

SEQ ID NO: 849 - DNA, 762 bp, Homo sapiens
  CDS (177)..(428)
gtggccgcgaatcaccagccagcctctgggtctgtagcaaccgcccagcgttgaggcgcggctcatgcccccagtatcccggtccagctattccgaggacatcgtgggctctcggagaaggcgacgcagctcctcggggagcccaccatccccgcagagcagatgttcctcttgggatggctgttcccgctctcactcccgcggccgtgagggcctcaggcctccttggagtgagttggacgtgggcgctctttacccctttagtcgctctgggtcgcgagggcggctcccaagattccgcaactacgccttcgcgtcctcctggtcgacctcgtatagtggatatcgctgccatcgtcactgctatgcagaagaacggcagtcagcggaagactacgagaaggaagagagccatcggcagaggaggctgaaggagagagagaggattggggaattgggagcgcctgaagtgtgggggccgtctccaaagttccctcagctagattctgacgaacataccccagttgaggatgaagaagaggtaacgcatcagaaaagcagcagttcagattccaactcggaagaacataggaaaaagaagaccagtcgttcaagaaacaagaaaaaaagaaagaataagtcgtctaaaagaaagcataggaaatattctgatagtgacagtaactcagagtctgacacaaattctgactctgatgatgataaaaagagagttaaagccaagaagaaaaaaaaaaaaaaaaa

SEQ ID NO: 850 - DNA, 1023 bp, Homo sapiens
  CDS (234)..(431)
ggaattcccgcgagcacatatctctgaatttcttgcaaattaaataagacgcagattctggctcaggaaagtgatgcatacgcgtcgttttcaaaggagagaccccagcctcgggtcaagcgcggcgcagacagcggcgcggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctggccattaggaagtgtgtaagggtccagctgatcaagaatggcaagaaaatcacagcctttgtacccaatgacggttgctttgaacttttatttgaggaaaatgatgaagttctgggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaactttcatatgaaacacacacagcaacaaaaaaaaatttgggggcgcggtgcggggcccagagaatgtctcagacactatcggggcggcgggggccagaggaacggacattgggcacagtggccaaggaaccgggccagagatacggctgtggttcccaccaaaaaacgccgggacccggtgcgacacccagggtccggggccacggttcacaaagggcaggtcgtacccccgcggtggataaaccgacaaagaaagaaacgaacaaaagcaacgcacagatcagctcaaactaacagagagtgaacacaagagagcgagaac

SEQ ID NO: 851 - DNA, 1573 bp, Homo sapiens
  CDS (97)..(1392)
acgcacgatggcgcgtccctgggctctgcggagaagggacccgagcagcccccggccctgtggaggaaggttgtggacttcctgctgaaggccatcatgcgcaccacgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgctcctttgtgaagtgtgttgcag

SEQ ID NO: 852 - DNA, 685 bp, Homo sapiens
  CDS (421)..(603)
gcacgagctgcagttcgcggtacagtctctagtagagcgcgtgtatagaggcagagaggagtgaagtccacagttcctctcctccaagaggtagaaggggcgcggggaaacgacctggtatcggttttccgcttgctgatcaagagctccctttaatgccgcacgcaggccggcgcccctcactgataaacgattggggctgggcctcggcctggagggcgttcgtcctctcagtgccctcagctcgtaaaggaggaaaccgaggcgtggggttgggcgagaacccaggggtcctcctgcacccccgccgccgtgtgtctcgtgtccagcgctggctggagcgcctcagccctggcgcggtgtagtcgtgagctggaacttctgacactgccccttccttccccgtccagcctgccgaccatgcccgcgggcgtgcccatgtccacctacctgaaaatgttcgcagccagtctcctggccatgtgcgcaggggcagaagtggtgcacaggtactaccgaccggacctgacaatacctgaaattccaccaaagcgtggagaactcaaaacggagcttttgggactgaaaaaaagattctgtgaataatataagtcttaaatatgtatttcctaatttattgcatcaaactacttgtccttaagcacttagtctaatgctaactgca

SEQ ID NO: 853 - DNA, 2459 bp, Homo sapiens
  CDS (127)..(1911)
gttcgggcggggcaggaggcccgggcgcctgggtccccgcgtctccctcagcgccgcggttgggtcacggccggctccgcgcaggttctgtggcctgatccccaggaggagctactctgggttaccatgagagagaccttggaggccctcagctccctgggattctctgtgggacagccagagatggccccccaaagtgagcccagggaaggatcccataatgcccaggagcagatgtcctcttctagggaagagagagcactgggggtgtgctcagggcacgaggcccctacaccggaggaaggtgcccacacagaacaagccgaggctccctgcagaggccaggcgtgctcagcacagaaggctcagcctgtgggtacctgcccaggagaggagtggatgattcggaaggtgaaggtggaggacgaagatcaggaggcagaagaggaggtcgaatggccccagcatctatcgttacttcccagcccctttcccgcgcctgacctggggcatctggctgccgcgtacaaactggagccaggggccccgggggcactgagtgggctcgcgctgtctgggtggggtccgatgccggagaagccctacggctgcggggagtgtgagcggcgcttccgggaccagctgacgttgcgactgcaccagcggctgcaccggggcgagggcccctgcgcctgcccggactgcggccgcagcttcacgcagcgcgcccacatgctactgcatcagcgcagccaccgcggcgagcggcctttcccgtgctccgagtgcgacaagcgcttcagcaagaaggcccatctgacccgccacctgcgcacgcacacgggcgagcggccctacccgtgcgcggagtgcggcaagcgcttcagccagaagatccacctgggctcgcaccaaaagacccacaccggcgagcggcccttcccctgcacggaatgcgagaagcgctttcgcaagaagacgcacttgattcggcaccagcgcatccatacgggcgagaggccctaccagtgcgcacagtgcgcacgcagcttcacgcacaagcagcacttggtgcggcaccaaagggtgcaccagacggccggcccggccaggccctctcccgactcgtccgcttctcctcattccactgccccgtccccgaccccatcctttcccgggccaaagcctttcgcgtgctccgactgcggcttgagcttcggctggaaaaagaacctcgccacgcaccagtgtctgcaccgcagcgagggtcgcccctttgggtgcgatgagtgcgcactgggcgccaccgtggatgcccccgccgccaagcccctggccagcgcgcctggcggaccgggctgcggcccaggatccgatcccgtggtgccccagcgcgccccctcgggcgagcggtccttcttctgcccggactgcgggcgcggcttctcccatgggcagcacctggcgcggcacccgcgcgtgcacacgggcgaacggcccttcgcctgcacgcagtgtgaccgccgcttcggctcgcggcctaatctggtcgcccactccagggcccacagcggcgccaggcctttcgcctgcgctcagtgcggccgccgcttcagccgcaagtcgcacctgggccgccaccaggcggtgcacactggcagccgcccccacgcctgcgccgtctgcgcccgcagcttcagctccaaaaccaacctagtccgccaccaggcgatccacacaggctcccgccccttctcctgcccgcagtgcggaaagagcttcagccgcaagacccacctggtgcggcaccagctcattcacggcgaagccgcccacgcggccccggacgccgcccttgcggccccagcctggtccgctccccccgaggtggcgccgcccccgctcttcttctgagcctagttctcacgaggaccctttcttgcccacagtttcgagaggcccgtgccatgagaccgcctggggtgagcaaggcgacctgggctgctgcccgaaggtttggccgccgcgggacacctgtttccttcccgcagtgtctgcgtccgcacagcatacccagctcggacctcctaggacagagactcagcgaacccttgctgggaaccgctgagctgaagttcttggaaggctcccacccaggtgccccgttggaaagcagatatttcccggacccagcgcggcctcaaccagggcaggaaagagtggttatttatgtacttaaagtttcattaaagttaaaatcggaaagttctggggctgctaaatgaattgggggagggaacacctgactctccttagccactgtcccacctccatccacacacagaccacccccctccacttccccttctgtcctgggtgagttacatttagccagctgctgttaattggttctcccaaataaaaatgtaatatatttattcactaaaaaaaaaaaaaaa

SEQ ID NO: 854 - DNA, 900 bp, Homo sapiens
  CDS (66)..(827)
cgtaggtccagtgagaacaggcgtgaaatttatatctctgcccaggactgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaagggctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggc

SEQ ID NO: 855 - DNA, 1017 bp, Homo sapiens
  CDS (66)..(944)
cgtaggtccagtgagaacaggcgtgaaatttatatctctgcccaggactgggtgcctgcatcgccatggacaccaccaggtacagcaagtggggcggcagctccgaggaggtccccggagggccctggggacgctgggtgcactggagcaggagacccctcttcttggccctggctgtcctggtcaccacagtcctttgggctgtgattctgagtatcctattgtccaaggcctccacggagcgcgcggcgctgcttgacggccacgacctgctgaggacaaacgcctcgaagcagacggcggcgctgggtgccctgaaggaggaggtcggagactgccacagctgctgctcggggacgcaggcgcagctgcagaccacgcgcgcggagcttggggaggcgcaggcgaagctgatggagcaggagagcgccctgcgggaactgcgtgagcgcgtgacccagggcttggctgaagccggcaggggccgtgaggacgtccgcactgagctgttccgggcgctggaggccgtgaggctccagaacaactcctgcgagccgtgccccacgtcgtggctgtccttcgagggctcctgctactttttctctgtgccaaagacgacgtgggcggcggcgcaggatcactgcgcagatgccagcgcgcacctggtgatcgttgggggcctggatgagcagggcttcctcactcggaacacgcgtggccgtggttactggctgggcctgagggctgtgcgccatctgggcaaggttcagggctaccagtgggtggacggagtctctctcagcttcagccactggaaccagggagagcccaatgacgcttgggggcgcgagaactgtgtcatgatgctgcacacggggctgtggaacgacgcaccgtgtgacagcgagaaggacggctggatctgtgagaaaaggcacaactgctgaccccgcccagtgccctggagccgcgcccattgcagcatgtcgtatcctgggggctgctcacctccctggc

SEQ ID NO: 856 - DNA, 580 bp, Homo sapiens
  CDS (74)..(319)
gcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatgtaagtatgtgaaaattcacaattattagaagtagtagatgttccctcgtctagtgggatgttatagtattaagtactgttatgttaagttcttaaatatatcatattagtactgttataacatttctgtcatcctgcccactaaatgtacttcttttagctgctggaatatcttaacaaacgaattgagaaaaagagcactgcagaaacaaagatataacatgataagatgttaaggtgataagttatataaggcgaacagtctccttt

SEQ ID NO: 857 - DNA, 368 bp, Homo sapiens
  CDS (45)..(230)
ggcttagctaggacctaggtttgcaaaagctcccagctgatctcatgcagccagcctggctctggctctggcgctgggagctgggttgggaactaatctttggggctattctgctgatacttcaagttgggctctttgactccgtcttgtattggcatcacttgtattcaggtctgttcttcccctggattgtaaactccttgatgtctgggtcatctcagctcatgagctgagctttcagtgggtgctcagtggaacaggtgctgaatggagtccggctctagggaggccagggtgtgttggtaagtgagagactaaaatccttttaaaaagaatctttttgcccttcagttgtgtttgccatgagt

SEQ ID NO: 858 - DNA, 1048 bp, Homo sapiens
  CDS (168)..(935)
gaatttccgggtcgacgatctcgtgcgttgggctgtaaagactaaggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgatccggaaatatggcctcaatatgtgccgccagtgtttccgtcagtacgcgaaggatatcggtttcattaagttggactaaatgctcttccttcagaggattatccggggcatctactcaatgtaaaaccatgataattctttgtatataaaataaacatttgaaaaaaccaaaaaaaaaa

SEQ ID NO: 859 - DNA, 1191 bp, Homo sapiens
  CDS (172)..(933)
tttcgtcgtagcccgagccccgccgccgtgtcgctcggcctgggcgtggccgtcgtgtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacgactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcatcaccagagcagaggcccagccagccctctgcagcccaaacgtccccaacggttgcctggcaccatctctctctgatgagacgaatctcattttcatttccat

SEQ ID NO: 860 - DNA, 2107 bp, Homo sapiens
  CDS (141)..(1865)
tgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaaaaaaaa

SEQ ID NO: 861 - DNA, 2227 bp, Homo sapiens
  CDS (6)..(2114)
ccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagaggagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaacagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgtttgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccag

SEQ ID NO: 862 - DNA, 585 bp, Homo sapiens
  CDS (296)..(457)
aagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgttttt

SEQ ID NO: 863 - DNA, 2105 bp, Homo sapiens
  CDS (405)..(1055)
cagcaggaaaaaatgaaagaaattaattctgaagaagagaaaattaatgatattacagtagaaattaataaaaccacagaaagggctcctgaaaattgtcatttggccaatgagataaaaccttctgacccaccattggataatcagatgaaacattcttttgattcagcatcaaataaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttaaaaaaaaaaaa

SEQ ID NO: 864 - DNA, 2290 bp, Homo sapiens
  CDS (49)..(1662)
gcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcagtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcaggggtcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccagacctccaagcttgcacagaggcaaggccagacttttccgtcgtttattttcaataaataagcagctcagcgcaaaaaaaaaaaa

SEQ ID NO: 865 - DNA, 1456 bp, Homo sapiens
  CDS (477)..(821)
aagcttgaaagtaagttgcttccatgagcatggattacccagtagctactttttaatagagactgactaggtttacaacttctgggagctactctgggggctgaattcttccaaaaccgagaaaagccagtgcagtctgatttcttttgcttttgtcagtaatggaatcttttgtttttaaaatgtacaaacctataagtttaaacaggtttgtactgacaacctccttggcttatttgggggtggagcaattgttttattccccagtttcagtgcgttgcccacttcaaacatggtgtgtcctttggagctgtgacagaggtgcctgttctgacttagaacctctggaggaggaggggggtgccttggtctcgtgttactttgctgtgcctgtgctgagagaccatgtgcccgagcatctggttgaccggcatgaagtacatcagcctgtcttagcctgagctgctttgaagaccatggggtcttgtgtttccaacttcgaagtgctgatgtggacagtttgccaatgttctcttctattgcaagttcagccagactccatgactcatctgatcccttttatggccaaatcatccttcagagtagggaacactcagacattctgtgcatgttgttcccccaaagcatggtcatcacaaagtcctgagttctggtgtgtgctcccgcctcctgggtatacagagagaaggcaggaatcaggagttccagaagcatatacatgtggctaccccagcaacaagcgcatcctgtgctcagataagctgcatggttgggagtgttttttctcgcacgttgaggcttagtggagatgggcaccactgccatttgctcagaagaaggctggtctggtcctaactgcatcccacactgcccagatcattctagaataggttatttctgaatgttttatagaatttcttaataccatcctggtttggtcagccattcctttgattggaaaggtcagctggggccagtggtgcctcaggcaggcccacacaactggccacctcttcccgttaatgaccacagcagacagaatttgagcccagcacctaaaagtacaggaatttcacttcccaccaggacttgagcacataactctatgtctgatctaggaggctgggggaagagcctcccataaaatcacacctactctgtggtaagaataaaatcccacccacctgggacttggtaatttctccagacaggaaagctttagaaaacttgagtgaaatggagcaagcttgaaggagttagaatcttctgtgcttagggtttgctgctgctggtgagcttagaattttggggttgggaaaaagtggaaggcataagcatagaaatattttaggatattttaggatatgtgaataaagctagactcaaaccatcataataaacattttttttttggacaaaagataaaaaaaaaaaa

SEQ ID NO: 866 - DNA, 2452 bp, Homo sapiens
  CDS (14)..(1882)
agcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaaaaaaaaaaa

SEQ ID NO: 867 - DNA, 1236 bp, Homo sapiens
  CDS (113)..(1147)
tttcgtggaggggcaaggcgagtgtgtgtccttatcctatcaattggggcgcgggcctgtgagccagttggagttgcggcggcgggaacgattgggctgagcagaggacgacatgttgcttttcgtggagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttccccaatggtagttttgtgaatggctttaattcgccaggatcttataaaacaaatgctgctgctatgaatatgggtcgaccattccaaaaaaaaaaaa

SEQ ID NO: 868 - DNA, 1899 bp, Homo sapiens
  CDS (314)..(1174)
cagtggcgcggcggccggcgccaacgccaatgccgtggccctgggcggcctgccccccggcggcggctcgcacccgcagcactacggccgcctgcccgggaccatctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggaggtgggaggaggagctcgccaagcgcatgaaccttcagaccatggtggacacgctgcaggaggcagcacaggaggctgatgccatccaggaggagatgaatgagaagatcgagcggctcaaggccgagctggtggtgtttaaggggcttatgagtgaccccatgacagacctggacacaaagatccaagaaaaggccatgaaggtggacatggacatctgccgccgaatcgacatcacggccaagctgtgcgatgtcgcacagcagcggaactcagaagacgtgtccaagatcttccaggtggtccccaaaaagaaagagcgtaaggtggcttccgatgatgacatctctgagcaggacggggaggtgaaccggttctcggacgatgaggtcggctccatgaacatcaccgatgagatgaagcgcatgtttaaccagctgcgggagacctttgactttgacgacgactgtgacagcctgacgtgggaagagaatgaagacacgctgctgctctgggaggatttcaccaactgcaatccgaccatcgacctgcagggcgagcaagaggaaaacttgggcaacttgatccatgagaccgaatccttcttcaagacgagagacaaggagtaccaggaaacgataggtcagatcgagctcgagctggccacagccaaaagtgacatgaaccgacacctgcacgagtacatggagatgtgcagcatgaagcgaggcctggacgtgcagatggagacctgccgccggctcatcaaaggctccgcagacaggaattcaccgtcccccagctccgtggccagcagcgactcaggaagtacagatgagatccaggatgagttcgagcgcgaggcggatgtggagcccatggtcagctgatgactgaggccctgcgagcctggtggtcttggtgatggggccctgccacctctcctcatggggccaggaaggcccctcggagtggggttcgaagccacaccacacagactttctctgccctcccttctctggaggccctgagggactgctgcttccttccttccttccacaccaccaacgggtgccccgtctccatcccccacccacccaaggaatggtgctgtcaatttctattgttctccacattacaaatgcagacttctgtgcggactttgcagtgttaactgtgccttctcccttaagctgagccactttgagctccaaagaattattcctagcaggtgtttttatacagaactctaagctgagggccgggccaaccggccgtggtgtaatgtggtttctgccgtccgtcccacctgctcctctgattggccatgggctatgccctcccttcctcctgagccagcccagactcggcctggagcttggggtgctctgccaacccccaggaaggagccgcttgcctctgtgagctttctaggcctgggtagggaccaccccaattttctcactccctgaaggagagaaaggtggaaggaagggaaggaggacacattttaattttttggggggatcgagtggcaaagttgaagggacaaggcactgtgaggggaaggcagagcctcactgtgtttaaactactatgcaaaaaaaaaaaa

SEQ ID NO: 869 - DNA, 3457 bp, Homo sapiens
  CDS (267)..(3137)
cggaccggaattcccgggacgacgatttcgtgtgagaagcagagtacagcgagactagcattcactgctggccagtgcctgcctttttcaccacctctaatttcagcttcagcagttgcttggaactttggttctggcagcagcagcaacatcattaccgctagcggcagttttgtgccgaggcacctacacacctcccgtcctctctgccagatcgcgggcctgtcggtgtctgctcctacacgccaacgccggtgggcaggaccatgtctctggtaagccagaattcgcgccgccgccgccgccgcgttgcaaaggctactgcgcacaacagcagctggggcgaaatgcaggcccctaatgcccccggtctccccgctgatgtgccaggctcagacgtcccccagggtcccagcgattcccagatcctccagggcctctgcgcctctgagggcccaagcacctccgttctgcccacctccgctgagggcccaagcacctttgtgccgcccaccatctctgaggcctcaagcgcctccgggcagcccaccatctctgagggacctggcacctccgtgctgcccacccccagtgagggcctaagcacctccgggcctcccaccatctctaaggggctgtgcacctctgtgacgcttgccgcctctgagggccggaacacctccaggccgcccacttcctctgaggaacctagcacctccgtgccgcccaccgcctctgaggtaccgagcacctccctgccgcccacccctggtgagggaacgagcacctccgtgccgcccacagcctatgagggaccaagcacctccgtggtgcccacccctgatgagggaccaagcacctccgtgctgcctacacctggtgagggaccaggcacctccgtgccgctcgccgccactgagggcctgagcacctccgtgcaggccactcctgatgagggaccgagcacctccgtgccgcccaccgccactgagggcctaagcacccccgtgccacccacccgtgatgagggaccgagcacctccgtgccggccactcctggtgagggaccgagcacctccgtgctgcccgccgcctctgacggacaaagcatctccttggtgcccacccgcggtaagggatcaagcacctccgtgccccccaccgccaccgagggcctgagcacctccgtgcagcccactgctggtgagggatcgagcacctccgtgccgcccacccctggtgggggactgagcacctccgtgccgcccaccgccactgaggagttgagcacctccgtgccgcccactcccggtgagggaccaagcacttccgtactgccaatccccggtgagggactgagcacctctgtgccgcccaccgcctctgatggatcggacacctccgtgccgcccactcctggtgagggcgcaagcaccttagtgcagcccaccgcccctgacggaccgggaagctccgtgctgcctaaccctggtgagggcccgagcacattgtttagctctagtgcttctgtggaccggaacccctccaagtgttcccttgttttgccaagccctagggtaaccaaggcctccgtggactcagattctgagggtcctaagggtgcagaaggccctatagaattcgaggtcctgagagactgtgagagccccaactccattagtattatgggcctcaatacttcccgggttgcaattaccctgaagccccaagaccctatggaacagaacgtagctgagctgttgcagttcctgctggtgaaggatcagagcaagtaccctatccgggagtctgaaatgcgggaatatattgttaaagaatatcgcaaccagtttcctgagatactcaggcgagcagcagcccacctggagtgcatttttaggtttgaattgagagaacttgaccctgaggcacacacctacattctgttaaacaaactgggacctgtgccctttgaagggttagaagagagcccaaatgggccaaagatgggcctcctgatgatgattctaggccaaatattcctgaatggcaaccaagccaaggaggctgagatttgggaaatgctctggaggatgggggtgcagcgggaaaggaggctttccatttttgggaacccaaagagacttctgtctgtggagtttgtatggcagcgttacttagactacaggccagtaactgactgtaaaccagtggagtatgagtttttctggggcccaagatcccacctagaaaccaccaagatgaaaattctgaagttcatggcgaaaatatataacaaagatcctatggattggccagagaaatacaacgaagctctggaagaagatgctgccagagcctttgctgagggttggcaggctctccctcactttaggaggcccttttttgaggaagctgctgcagaggtaccatcccctgattcagaggtttccagctattcctcaaaatatgccccacattcatggcctgagtcaagattggagagcaaggcaaggaagctggtgcagttatttctgcttatggattcaactaagctgcctataccaaagaaaggaattctgtactacattggccgagagtgcagcaaagtgttccctgacctcctgaatcgtgctgcccgcaccctgaaccatgtctatgggacagaactagtggtacttgatcccaggaatcactcctatactctgtacaaccgaagggagatggaagaaactgaggagatcgtagacagtccaaacaggcctggcaacaactttttgatgcaggtcctaagcttcatctttattatgggcaaccatgccagggagtctgcagtctgggcctttctgcggggcttaggggttcaagctgggagaaagcatgtgattacctgcagatacttgagtcagcgctatatagacagtttacgggttcctgacagtgatccagtgcaatatgagtttgtatggggtcctagagcccgtttggaaacctctaagatgaaagccttgcgatatgtggccagaatccacagaaaggaaccacaggactggccacagcagtacagggaggcaatggaagatgaggccaatagagctgatgttgggcacaggcaaatctttgttcacaacttcaggtaaaggaatgcatggcagtcagaggggccttgcaaggaggggcctttgagcctcagttctcatgtattggggggtgggggtgggtacatattgtatttggtatttgtgttccagttatatttatgtcttttcatatttagttctggtgtggggtctggaaatgtttcaactgttttaatatattgtctgattgggtaaatgtgattgaccacttgctgtctctgttgtattttggtatgagttttgatagctctataaaatgttttggaaatctttccatcttgttgcattatctagaaaagaatatagcatatagctat

SEQ ID NO: 870 - DNA, 3156 bp, Homo sapiens
  CDS (478)..(2565)
atgagctacttcgcccacccggaggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggcattcgagctgctcatccccttctcctgtgaggacgtgtcatccgtgggccgtgccccagcctccatgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcacgtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggaggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgattgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaaaaaaaaaaaaa

SEQ ID NO: 871 - DNA, 2903 bp, Homo sapiens
  CDS (93)..(1055)
aaggatccttaattaaataatcccccccccccccggccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcattgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcaccctgtctctggcccatgaggggctgcagcactgtgggcgccagagcacagattaaactctcaaacccacactggctcatgtgaccttgctctcaccttgcattggcccgggggatgccgtctcaccacgggagggaggactcatagtatatgggtatctgaggcctccactccatacg

SEQ ID NO: 872 - DNA, 2496 bp, Homo sapiens
  CDS (72)..(1829)
gtgctggggaaagctcctccgtgcagcagcagaagaaagtcctgtctggccgagaggagcagctgcaggtgatggagaaggccacacaggctggtggcccaaaccccacaggcaggcggagagactccggggccggagctgcggcgctggcccgaccaacccctgcgccccctgcaccccaacccggggcctggggcgcgcgggaggtggacgaagcggtaggtcccgggttcccgcgaggtgggcggggagccgcagcgccggggctcgtcagcagagggcgccggccccgggacgaggtgcgcatgcgtcctgggggcgctttccggcagcgtggcggaaccagccacttcgtttcgcgccgtttagcgacacctgcgcgcggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaacaaaaaaaaaaaaa

SEQ ID NO: 873 - DNA, 1642 bp, Homo sapiens
  CDS (52)..(1233)
cacatccacctccagcagcttacctgcttttccattacctgctccagcaccatgtcttacagttgttgcctgcccagcctgggctgccgcaccagctgctcctcccggccctgcgtgccccccagctgccacggctacaccctgcctggggcctgcaacatccccgccaatgtgagcaactgcaactggttctgtgagggctccttcaatggcagcgagaaggagactatgcagttcctgaacgaccgcctggccagctacctggagaaggtgcgtcagctggagcgggacaacgcggagctggagaaactcatccaggagcggtcccagcagcaggagcccttgctgtgccccagctaccagtcctacttcaagaccattgaggagctccagcagaagattctgtgtgccaaggctgagaatgccaggctggtggtgaacattgacaatgccaagctggcctctgacgacttcagaagcaggtaccagacggagcagtccctgaggctgttggtggagtcggacatcaacagcatacgcaggatcctggatgagctgaccctctgcaagtctgacctggagtcccaggtggagtccctgagggaggagctgatctgcttgaagaagaaccatgaggaggaggttaacaccctgcgctcccagcttggagaccgcctcaacgtggaggtggacactgcccccactgtggacctgaaccaggtcctgaacgagaccaggagtcagtatgaggctctggtggaaactaaccgcagggaagtggagcaatggttcgccacgcagaccgaggagctgaacaagcaggtggtatccagctcagagcagctgcagtcctgccaggcggagatcatcgagctgagacgcacagtcaacgccctggagatcgagctgcaggcccagcacaacctgcgagactctctggaaaacacgctgacggagagcgaggcccactacagctcccagctgtcccaggtgcagagcctgatcaccaacgtggagtctcagctggcagagatccgctgtgacctggagcggcagaaccaggagtaccaggtgctgctggacgtgcgtgcccggctggagtgtgagatcaacacgtaccggagcctcctggagagtgaggactgcaagctcccctgcaacccatgcgccaccaccaatgctagtggcaactcctgtggaccctgtggcacctctcaaaagggttgctgtaattgaaaagcttgtatcctctttgaagacatctacaaagccatttagatcaaccacaggaaggatcctcaagtcctgacttttctggagctcagctgacatcaagaaacctcatcttgcctctatgttatttctagaatgctgaaaagctttcctgacccaagcaaagacacacatcatcaacttccaatgtctggacaactccttcctgttgagggtcgagcctgtttgtttctaaagatgttcagctccctgtaatctgagctccagttactacttaaggtgtttcctgaacgtactactgcatttcctgttttccttttttctttggcattctctggaatgcaaggaggagacttcatttacttcccaataaacttcatttctctggcataataaaaaaaaaaaaaaa

SEQ ID NO: 874 - DNA, 1058 bp, Homo sapiens
  CDS (54)..(593)
cacctccctctcacctgctcctctacctgctccaccctcaacccaccagaaccatgggctgctgtggctgctccggctgtgggggctgtggctccggctgtgggggctgtggctctggctgtgggggatgtggctccagctgctctgtgcccgtctgctgctgcaagcccgtgtgctgctgtgtgccagcctgttcctgctccagctgtggctcctgtgggggctccaagggaggctgtggctcctgtgggggctccaaggggggctgtggctcttgtgggggttctaaggggggctgtggttcttgtggctgctcccagtgcagctgctataagccctgctgctgctcctcaggctgtgggtcatcctgctgccagtccagctgctgtaagccctgctgctgccagtccagctgctgtaagccctgctgctgccagtccagctgctgtaagccctgctgctgccagtccagctgctgtaagccctgctgctgttcctcaggctgtgggtcatcctgctgccagtccagttgctgcaatccctgctgctcccagtctagctgctgtgtccccgtgtgctgccagtgtaagatctgaggctctggactcaggtctcatgtgagtcctgctaaccccattttccgaagctgtgacctgtccttcatcgttgagccccaaaccactgctcagggtccattcctcactataagatgaagccatatctgcctgccttttcctaaggagagtccaccctaattaatgtccattccctcctaacaaattctcttcccaagtcaactgcaactgcggctgaatcacccctcacccgctagccttgcctttgcttgtgtattcagaggcctgagctcctgaacccacttgaagtcctgtcttttccagctggagcagctgggcatgagtgtcccacctgcaacaaggtgggcgtttaagaggcttccttggagtggctttgcctgtccaacactctgctttatcttaaatgaaaagttgcaaactaataaaaataccatgccgacaaactgaaaaaaaaaaaaaaaa

SEQ ID NO: 875 - DNA, 1063 bp, Homo sapiens
  CDS (2)..(802)
gatggctccggccgcggaccgagagggctactggggccccacgacctccacgctggactggtgcgaggagaactactccgtgacctggtacatcgccgagttctggaatacagtgagtaacctgatcatgattatacctccaatgttcggtgcaattcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccaatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattgatgaatcattccaccaagaaaacaaacaagcacctaccatagacctggcagaataaataaggaaatccttaaagatctacaagttcaaatatgtcatgaccatcacagcagaggagtgactttctgactaatgctgccacccacacagagaataaggagtagggcctgctgggtgtttagctcatggctttatcttatttgtccccctcctcctttcacgctccagtttataaagaaacagagatgaaaaaaaaaaaaa

SEQ ID NO: 876 - DNA, 583 bp, Homo sapiens
  CDS (100)..(423)
cggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcacgccgtccgggtgggcctagcagtcgctccatttatcgcttgagatctccagccttaccgcggctcgaaatggaccccaactgctcctgcaccactggtgtctcctgcgcctgcaccggctcctgcaagtgcaaagagtgcaaatgcacctcctgcaagaagagctgctgctcctgctgccccgtgggctgtgccaagtgtgcccacggctgtgtctgcaaagggacgttggagaactgcagctgctgtgcctgatgtgggaacagctcttctcccagatgttaatagaacaagctgcacaacctggattttttttcaatacgatactgagccatttgctgcatttctttttatgttaaatatgtgagtgacaataaaacaattttgacttgaatcttaaaaaaaaaaaaaa

SEQ ID NO: 877 - DNA, 2082 bp, Homo sapiens
  CDS (67)..(2079)
ctctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagtagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactgttaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatga

SEQ ID NO: 878 - DNA, 1455 bp, Homo sapiens
  CDS (4)..(564)
cggatgctgacgctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccggggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtaactccagcaagaggaaatatgacactcccaaaacgaagaagactgattggggtcaaggctctttccaagaatcagggtcttccagaaacagggttcagaaccagggtcataagcgatcttcttgatcgggactatgcggtaagctgtgcccatgaaggcgcactgtgggaacgtgctgggcacaagaatgaaggacgtgacgccacgttgagttccacccgtgtcccccccttcgaagttgcgagcccacaccacaagccaccaaagcatgcaacaacacaggagcgcagagcagcaccagcgacacgagaagcgccaagacgcagaagcccgcccgacaacgggcgagcgcagccggcccagcgccggaggcgagcaccccgccacgcgcagcacgcgagcaaaccaagcacccagagagcaccgagcacaggggaccacgagacgacggacgagccagcgagcaggccgacggagcatacggcgcgagtagcggagcacgcagcgagacgcggaccgcccgaaggggcacgcacgccacgacaccgacaaggaaacggagacaacaccccgcacccaccaaacgagacacaaagcggcaggacgcagagcgacaagaccggcgcagcagcaacacaccaaaccgagcacgacacgcagaaggacaacagaggaaggacagggcggtgagagtgcgccgacaaagacgagatgccgcgacgcggacgaagcgagcgagccagcgaacacatgaaggcacgcagggacaacgagccgagacgacgcagaaaacgaccgagagaccaggcccgacgcacacacaacaaagcgaagcgacacaccaacacagcgcaagcagaagccacagccacagacgagcccagaagac

SEQ ID NO: 879 - DNA, 2506 bp, Homo sapiens
  CDS (481)..(2154)
cgcggacgtggaagaacctcgtctgcggaggaaaaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaacatggttgactctgggacagaagcaagggctagaggaaaggctgaggctggcctgcaagatggaatcagtggtcctgccactgctagagtgaatggtaaaacccaggccgaggcagtggctgaggcagaactgaaaacagaatcagtgacccaggccaaagctggtgatggagcaatgaccaggacacatacagtgacctacagggaggctatggctgtgacaagggaagtgatcaaggtggaagatacaactaagactagagtcatggttgagactaagacaaaacccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaatatttgagaatataaattttcagttcaaaacaaaggcaaagctatttaccaaggaaaagttcactaaatctgagcttatttcaatattccaggaagcaaaacagtttggtcagaaactccaagacttagcagagcacagtgatcccgaagtgagagataaagtcatacgattaatactaaaactctgaatacccctctgttctcataaagcctcaaacagttttttggagttgcaatatgaaaccaatgcatattgtaattataaattcaatacttatgttttccatgttgattgagggaggcaattttatggataccaattaatcttgagatcctgaacatgtgctgatttttattgtgctatatagtatataaattgagatatttttggtatttctgcaacgtgacctgataatgaatctattcatcctgagtaagctatacttctgtgctttatattgatatgtgtattcttttgagattttatttacatgttgttaataaagttgcatgctaaaactggtgaaaaaaaaaaaa

SEQ ID NO: 880 - DNA, 2148 bp, Homo sapiens
  CDS (71)..(1957)
  misc_feature (1)...(2148): n = a,t,c or g
tgcggtgagaggaacgctgaattgccgaagagaattggctgcgcttccttgtttgtgagctanaatgagaatggcgatcagtccacgaagcgatgcaactttctccagtcagaaatcaacaccttcagagagtcctcgaacaaagaaatttccactaactgaagaggaaatattttatatgaattgtagagctgcctacttaactgtcttcaaaagcagcttggaaaacattatttctaaagatcaactttacttagctcttcagcatgcaggaagaaatccatcccaaaagaccattaataagtattggactcctcaaactgccaaactgaattttgatgatttttgtataattttaaggaaggaaaaacctacttcaaaagcagaactactaaaatcatttaagcaattagatgtaaatgatgatggctgtattttacacactgacctttataaatttctaacaaagagaggtgagaagatgactcgagaagaagtaaatgccataataaatttggctgatgtaaatgctgatggcaaatttgactacatcaagttttgtaaattatatatgacaaccaacgagcaatgtctcaagactacactagaaaaactagaggttgacagtaaattgatgcgtcaccagtttggaaaccacatcgaagggtcccctgaaagggacccatcaccagtaccaaaaccatcacctaaaatcacaagaaaaactgatccagaaacattcttaaataaaggtgacaccaggagttctttactgtcagcaaccaggaagttcaaaacatctgtttccttcacagttaccatgggggctaatggtaaccgaaactcaaagttaatggagccaaatttaataaaggactggcaacacatgcaatcaaaaggttgcttcttcttagaagaagatggtgaaatcattagtcatcagtacaggatgcaaatagctcagaggtccatggtttatctaacaattaagccattaaacctgagtcaagttgaaggaaaaccatccccttggttatccgttgatactgccttgtatattctcaaggaaaatgagagtcaagcaaatctacagcttgtgtgttttaccgaactacgaaatagagaagtgtttggatggactggtgaactaggacctggaatttactggttaattccttccacaactggctgtaggctgaggaaaaaaataaaaccagtaacagatgaagcccaacttgtatatagagatgaaacaggggaattattccttacaaaggaatttaagtctactttatcagatatatttgaagtaattgatttagatggaaatggtcttcttagccttgaagaatataatttttttgaattgagaacaagtggtgagaaatgtgatgaagatgcttgggctgtctgcagagagaattttgatacaaagaggaatgaactaacaagacaaggatttatggatttgaatctaatggaagctaatgatcgagaaggagatccttgtgacctttgggtaactctacactctatgggctacaataaagctctggagttgacagaggcatgtccatttgtcattgatatctatgcagaaaaatgcaagccaaaaattaaagctgtccatatggaggcatgtagtggacaacttgagaaggccatttgtaaatctgttcttagcaacggtgatgccaaagtaatggatggctatgaaaatataatcgtgcatacttacagttgtgacacctggataacgtcagttattgaaaacaagtcagatgagaaagtgattattcacatcagcaatgagctaagtaaaaactgcataaacaacagaggactcaacatatttgcagtagaagtgggacccaaatctacaatggtttgtcaacatgtaatgcctttgaatgaacgacaagaatggatatattattgtatatattctcttatttcttaaataattatacttagaacttaccaaactaagaattatttcagatttagtctgttatttattaaacaactaaatgctacttaactgatgtacctaaataataatctattcaatttatatgcattttcattttatgtccatggtatgtactttattattaaaatataaataatgctttcaaaaaaaaaaaa

SEQ ID NO: 881 - DNA, 4530 bp, Homo sapiens
  CDS (330)..(4265)
gcactgtggggcgtcatcgcgggctaccgcggccccgcccacttcacctctcaccccattagctgtccccgcgcgacagaggcggtgcgcggactacgcctcccggcgtgcatcgcgcggaccccgccccatgtgtcccattggcttctgggaaaccgagtgcggttgccttcccgccggccttcacgtcgccgtgctcggtacttgaaatcccggcaagctcggcggcgctttagctccgcctctctcctcctttgctcacgaaccccgccccagcccgccccgccccgcgccggggccggagccgcagcccgagcggcggggtgaccatggaggaagaagatgagtctcgagggaagacagaggagtcgggggaggatcggggcgatggtccgccagacagagaccccacgctttctccttctgcctttatcctgcgagccatccagcaggctgtgggaagctccctgcagggggacctgcccaatgataaagatggctctcggtgtcatggccttcgatggcggcgctgccggagtccacggtcagagccccgttcccaggaatcagggggcactgacacggctactgtgttggacatggccacggacagcttcctcgcagggctggtgagtgtcctggatcccccggatacctgggttcccagccgcctggacctgcggcctggcgaaagtgaggacatgctggagctggtggctgaggtccgaatcggggacagagatcccatccctctgcctgtgcccagcctgctgccccgtctcagggcctggaggacgggcaaaacggtttctccacagtcgaactcctctaggcccacctgtgcccgtcacctcaccttgggcacgggagacgggggccctgccccaccccctgccccctcctctgcatcctcctccccttccccttctccctcatcttcctccccttcccctcccccacccccaccgccccctgcacccccagccccacctgccccccgattcgatatctatgaccccttccaccccaccgacgaggcctactctccaccgcctgctccggagcaaaagtacgacccttttgagcccaccggctccaaccccagctcatcagcggggaccccctcacctgaggaggaagaggaggaggaagaggaagaagaagaggaagaggaagacgaggaggaggaggaaggcctgtcccagagcatcagccgcatctcggagaccctggcgggcatctacgatgacaacagcctgagccaggacttcccaggtgacgagagcccccgcccggacgcgcagcccacacagccgactcccgcccctggaacgccgccccaggtggactccacccgggctgatggagccatgcgccggcgggtcttcgtggtggggaccgaggcagaggcttgtcgggaaggcaaggtctcggtggaggtggtgaccgctggtggagccgccctcccgccgcccctgctgccgcccggcgactcggagatcgaggaaggggagatcgtccagccggaggaggagcccaggctggcgctgtccctcttccgccccggcggccgggccgcccggcctacaccggccgcctcggccacccccacggcccagccccttcctcagcctcccgctccgcgggcccccgagggggacgacttcttgtccctgcatgcggagtcggacggcgagggcgccctgcaggtggacctaggggagccggctcccgcgccgcccgccgccgactcgcgctggggcggcctggacctgcgccgcaagatcctgacccaacggcgggagcgctaccgccagcgctcgccctccccggcgcccgcgcccgccccggccgccgctgctggtccgcccacgcgcaagaagtccaggcgggaacgcaagcgcagcggcgaggccaaggaggccgcctcgtcctcgtcgggcacccagccagcgccgcccgccccggcctcgccctgggactccaagaagcaccgctcgcgggaccgcaagcccggctcccacgcctcgtcgtccgcccgccgccgctcccgctcccgctcccgctcccgctccacccgccgccgctcgcgcagcaccgaccgccgccgcgggggcagccgcaggtcgcggtcccgggagaagcggcgacggcggcggcgctccgcctccccgcccccggccacttcctcatcgtcgtcctcgaggcgcgagcggcaccgcgggaaacaccgggacggtggcggcagcaagaagaagaagaagcggtcgcggtcccggggtgagaagcggtctggggatggcagcgagaaggccccggcgcccgccccgccgccctctggctccacctcgtgtggtgaccgcgacagccgccgccggggggccgtgccaccctccatccaggacctcacggaccacgacctcttcgccatcaagcggaccatcacggtgggccggcttgacaagtccgacccccgaggaccctctcctgctccggcctcctcacctaagcgggaggtcctgtacgactccgagggactgagcggcgaggagcggggcggcaagagcagccagaaggatcggcgccgctcgggggccgcctcctcctcctcctcttcccgggagaaggggtctcgtcggaaggcgctggacgggggtgaccgggatcgggacagggacagagatagggacagggacaggtcatccaagaaggcccggccccccaaggagtcggcgccttcctcagggcccccgccaaagccaccagtcagcagcggctcaggctcttcatcctcgtcgtcctcctgttcttcccggaaggtgaagctgcagtccaaggtggcggtgctgatccgcgagggtgtcagcagcaccaccccggccaaggatgccgcgtcagccggcctgggctccattggcgtcaaattcagccgtgaccgcgagagtcgctcccccttcctcaaacctgacgagcgggcccccactgagatggccaaagcagctccgggcagcaccaagcccaaaaagaccaaggtcaaggccaaggcaggggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgccccccaaggcagccccaccaccccctgccctcactccggactcgcagaccgtggacagcagctgcaagacacctgaggtctccttcctgcccgaggaggccactgaggaggctggggtccgaggtggggcggaggaggaggaggaggaagaagaagaggaggaggaagaggaagaggaggaggagcagcagcctgctaccaccacggccaccagcactgctgcagccgccccaagcactgcccccagcgcggggtccacagccggtgactcgggggcggaggacgggccagcttcccgtgtctcccagctgcccacgctgcccccgcccatgccctggaatctgccagctggtgtggactgcaccaccagcggcgtcctggccttgactgcacttctcttcaagatggaagaagccaacctggcgagccgagcgaaggcccaggagctgatccaggccaccaaccagatcctcagccacagaaagccaccctcaagtctggggatgaccccagctcctgtgcccacctctttgggtctgccccctggcccctccagctacctgcttcctggcagcctccctctggggggctgcggttcgaccccccccacccccaccgggctggctgccacgtctgacaagagagagggcagcagcagctctgagggccgtggggacacagataagtatctgaagaagctgcacacgcaggagcgggcggtggaggaggtgaagctggccatcaagccatactatcagaagaaggacatcaccaaggaggagtacaaggacatcctgaggaaggccgtccacaagatctgccacagcaaaagtggggaaatcaacccagtgaaggtgagcaacctggtgcgggcctacgtccagcgctaccgctacttccgcaagcacggtcgcaagccaggggaccccccagggcccccacggccgcccaaggagccagggcccccagacaagggtggcccgggcctgcccctgccccctctctgagagccctggccagctcttcgcccctcacctctttgaaactctggacgtatttatggctccacctccccacctccctcccccgtcagtgggatgactgggggagggttgctgcagggaagaggagagccccctgccctgccctgccccgtgtccacctcccttgcccccaagcctgtccccagtgcccctcccttctgtttgtgcccctctccccaatttcattaaagatttcatgaaacattacccctgaaaaaaaaaaaaa

SEQ ID NO: 882 - DNA, 822 bp, Homo sapiens
  CDS (15)..(656)
aaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcaaaaaaaaaaaaaaa

SEQ ID NO: 883 - DNA, 838 bp, Homo sapiens
  CDS (79)..(555)
tttcgtccggaagtgcggatcccagcggcggtcgtgtagctgagcagccctggggcttggttctatgtccctgtggctatgtttccagtgtcctctgggtgtttccaagagcaacaagaaacgaataaatctctgccctgcagcgcctccaccccagagacccggaccaagttcacacaggacaatctgtgccacgcccagcgcgagcgcctggactcggccaacctgtgggtgcttgtggactgcatccttcgcgacacctccgaggacctgggactccagtgtgacgccgtgaacctggccttcgggcgccgctgtgaggaactggaggacgtgcggcacaagctgcagcaccacctgcacaagatgctgcgggaaatcacagatcaggaacacaacgtggtggcactgaaggaggccatcaaggacaaggaggaacctctgcacatagcccagacccggctgtacctgccctcacaccagcccaacatgcagctgtgccgcgaagcagcccagttcagccccagctcacaccccccaacacccccaagctggtgagtgaggtggaggagctgtacaagtccatcacagtgccgcgggagaagcttctacaagcagagcagtccctgtgcaacctcgaggacatccacatgagcctggagaaggacatcaccgccatgaccaacagtctcttcatcgaccgccagaagtgcatggcccatcgtacttgctaccccaccatcctgcagctggctggctaccagtgagcagcggcacggtgcttccccccaatcccccaaataaacagtgcgttagctttctgcaaaaaaaaaaaaaa

SEQ ID NO: 884 - DNA, 3929 bp, Homo sapiens
  CDS (1307)..(1621)
tgcacacattgtgttcttaaactgagacgtggctctgcaggtctcctgggctcattccatggtgtggtatgtttattccactgtccagagctattctctgatggatttgagcaacagcagtggagataaatgtcctagagtcaccaggtcgcttggagaagtcatttaagctgcctcgggtttttgttacttaaatgtggatattatttctccacctaaatcactgagtttacagagtaataatgtgttgctctggacattgacagctttctagagccagtaatgggctcttctgaaggatgctgaattagaagtgaacctattcataggatcaaaagccacttgctttgaaatatgtagagttcctcagaattgacggtgctagaaatatccaagtgttaaataaccttttaaaagcaacaaaagctacttttttcttaccacttaatagaagaacctgtccctagaggcgacttcattgctatggatctggagtctctgaactcttaataggatgcagcctcacatacataatgtcacccattttatgttgatgaaaacattacaagttttcttcattgggtatgtgttgatgttcacagacagtacttgggcccattaggttttcgcgtctggtcttagagcatgtgtattcatctcagcgtgaatacctcagccagtcttatgaataggaggctatgtatgggcagggaatagattagattagaacactcgcacaagatgaccacatatagaagcagaaagccccaaattccctgggaactgttttttctctagtagctgaatataaggaaatatgtctaatggacaccagttaatactttttaaaactactctttaaaaaaaaaatacgttccccttggttaactgattttttaatccagggtggacattttttcaacctttattaacaccgacaaataaactattttgtagaagatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacattcataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttacgtgaataaatgaatgcttgccaagatctcttcttccctcaagtttctggaaaacctgagggttcgtgatacctgttcccactcctcatcagcgggctggcaagaaagcaaataaggggaaacatttttaacattccaagcaagagaaggaagaacgactattgggaggaggtacaccagagattgctcagtgggcagcctgctacctcacttttggctctggattgcctgggggtaaaagggaaaagtattatgtagttagcaccttacatatttgatgctcaggaagaaagggcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatcacttgcgattgccagtcatttctgtgccagttgctttcattccagagaatggcctcattctccaaaaaaagatgatgattttagaagtaggatttcctaacaaattatgtggtggggagggacggcggggattttattcatcccgtctgagctcttcatacagtattaccattaggttttaagaacaaagatgggggaggagggagtagaaagctgagagtacgtagaacagctacaagacattagtgggtattcagattttgagctgtgtaaatatcaaacatcggcttccagccttaagagttatttgagcagagagttaaggaggaatgggagattttgtgaataaaatgttttgccaaactgaatgagtctttttgccattattatagagagctattttttaccttctgaaacaactcatcagacatctggggtttatcttgaattgtaccatcattgtttcttaataaaagtgataaatttcaaaaaaaaaaaaaa

SEQ ID NO: 885 - DNA, 1820 bp, Homo sapiens
  CDS (424)..(1518)
gtgctgtacagtgtgagggaacgtgtaccaaacgctctgcgggatacctgtgcccgtctagccaagagtgcacccgtgtgcgcgagcgggcttctgggacgccgccgtggtcgggggcggccctgcgaggggagggggtcacagggactggccggcgccggccccgtgcgcacggaggcgggggcggggggcgggggccgcgaggggggaggcggtacgaaaagggcggcgcgcgcggcggcggcggcagctccccggcagcggcggtggtagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagagcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagtaagagaaataagtatgttattctaaaatctaaactcaaatgaaatttcaaaaaagaccaaaaaaaaa

SEQ ID NO: 886 - DNA, 1423 bp, Homo sapiens
  CDS (191)..(1180)
cagatctgtcttagaggggccaggtgcagagaaaggcagaaatcctaataatgttcccagcgatcgctgcctgtcgcggagtgctgaagggccaagtgttgatctgagtcctcatcacacgggacttcatttagtctcacgataggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgccctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgcttatgattatctcattccatatctcagggcgaggcaggaggaaatggctcaacacaccaacaatagaaagaacctacagacatacgcgtggattaaggg

SEQ ID NO: 887 - DNA, 2772 bp, Homo sapiens
  CDS (304)..(2178)
gggccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccagggtctgaacacagggcctgggtgccaggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatgggggtggagaacactgggcagagttggcccctctgtggccagctggccctcagcccagcagagaggggcatcaaccaaggaaggggccatgctggggtgctgctcagctgttacaaaggcagg

SEQ ID NO: 888 - DNA, 2911 bp, Homo sapiens
  CDS (1)..(1515)
atgtcggccgaggagatggtgcagatccgcctggaggaccgctgctacccggtgagcaagaggaagctcatcgagcagagcgactacttccgcgccctctaccgctccggcatgcgcgaggccctgagccaggaggccggcggcccggaggtgcagcagctgcgcggcctcagcgcgccgggcctgcggctggtgctggacttcatcaacgccggcggggcccgcgaaggctggctcctgggcccgcgcggggaaaagggcggcggggtggacgaggacgaggagatggatgaggtgagcctgctgtccgagctggtggaggcggcctccttcctgcaggtcacgtccctgctgcagctgctgctgtcccaggtgcggctcaataactgcctggagatgtaccgcctggcgcaggtgtacgggctgcccgacctgcaggaggcctgcctgcgcttcatggtcgtccacttccacgaggtgctgtgcaagccccagttccacctcctggggtctcctccccaagctccaggggatgtcagcctgaagcagaggctgagggaggcccggatgactgggactcctgtcctcgtggccctcggggacttcctggggggacccctggcccctcacccctaccagggggagcccccgtccatgctcaggtacgaggagatgactgagcgttggttcccgctggccaacaaccttcctcccgacctggtcaatgtcaggggctatgggtctgccatcctggacaactacctcttcatagtgggcgggtacaggatcactagccaggagatctccgctgcgcattcctacaaccccagcaccaacgagtggctccaggtggcctccatgaaccagaagaggtctaacttcaaacttgtggctgttaattcaaaactctatgccatcggagggcaggccgtttctaacgttgagtgttacaaccccgagcaggatgcgtggaattttgtggcgcccttacccaatcctctggctgagttctctgcctgtgagtgtaagggaaaaatttatgccatcggaggatacactaccagagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaa

SEQ ID NO: 889 - DNA, 3195 bp, Homo sapiens
  CDS (1)..(1755)
  misc_feature (1)...(3195): n = a,t,c or g
atgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttttgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatgtgtgttagaaagaatgcagacacctttgcagtgttgagcccctctgaatgttctttcctggagagaccgcccagtcagcattcctgccacctcaagccttgcggagccaaatggtatagcaccgaatggagcatgcgttccaagagctgccacagtggctgtcggctccggaaagcgcggcgtctgtctgatgacatgactctaagtaacctgtgtgaccctcagctgaaaccagaagagagagaatcttgtaccctcaggactgtgttcctgaagcagatgaaaactgcatggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagccaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctccgccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatcccatttttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccnnangagcgcaggcctggaaggatgcagtgcatattgaaaggtggaccctctgaaaacagttaagaggaatatatgtatgttttacccattaagaaaaaatggcaagctaaacaaatgttaaacttacagaaaaaaaaaa

SEQ ID NO: 890 - DNA, 1700 bp, Homo sapiens
  CDS (317)..(1447)
cttaaggcaggtctggtttggacgactttgttttgtctcccagtattgaaggcttttactctggacttgaatcctcgcctttggtttttgttcagaggaaagcgttcctctcccctgcgcaggatcgctctgtttctcagtaaacatgacgagggggtttagcactttttaagtacatataagctggtgactctagaagggtacagatttggagaatgcctgcgccggtcctattcttttttcctggggtttctggattttagtcttttaagtggatcctcccgtcggattactagaacgggcggaggcgcaggccatgctgcggctggtgcccaccggggcccgggccatcgaggacatgtcgtacgcccgccacttcctggacttacagggctccgccattccccaagccatgcagaagctgggggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaaaaaaaaaaaaaaa

SEQ ID NO: 891 - DNA, 1721 bp, Homo sapiens
  CDS (259)..(1308)
tttcgttgctggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgcccaccttggctgtcctgcgaggagctgagaacagaagtgagacagctgaagcgtgttggggaaggagctgtaaagagagtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtcatatatctaataaggaattgatatccagtgtacatgtaaaactcctgtaattcaatacagaaaccaaacagtccaattaataaatggagaagagatttgaatgaacatttttgtaaagaacatctcaagctcaagatttcccagataacttttctttcttcaaaatctgcttctgtgtttcctcatctgtaggtggcacagcatacatctgatttcccaagccagaagcctcatagttattcttgactccaggaagaaatagtattgagtttgtaaaaactcggccagtggactcattgttgtatataatataatgcagcagttttaagtgtatatcgcaatgagttgtaagactcttatgtactggcgtcactatcctcatagat

SEQ ID NO: 892 - DNA, 1049 bp, Homo sapiens
  CDS (165)..(782)
ctgtttccgtggaggaaggcagacttcagactgaaggacagagaaggcaactgccctacagccctgcaggtcttcaagtctgtggttgtgggcactaacccagacaagaaaaggaaagacctgcagtatcggtgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgtcccatatgtttaatgtctttggcctttaattctgatttctctgatgggaatattgccagtcctgcttttcctggcaggcatttgccggcctatgtgctttaaccttaagctgatactttcctttaggtgtcactcttgttaccagcagacttttgacccaactacagtgctctgtcttttagtagaggattttcacccatgtgcatggaataaatgttcatggtacattgtaaaataacaataaaaaagagttttcagaaccatgaaaaaaaaaaaa

SEQ ID NO: 893 - DNA, 2078 bp, Homo sapiens
  CDS (415)..(1920)
tttcgtcgggagaccctgtgcccctaaatcgcggtccactgcgcgcgtcaggtttctagaagcagggtagaacagagggcagacacctagcccaggctggtgttgttactaaacaatggcagctggtgagccaagggtgaccagggccctgaactctgtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaagaagccagtcacctttgaggatgtggcagtgaatttcacccaggaagagtgggactgtctagatgccagccagagggtcctttaccaggatgttatgtcggaaacctttaagaatctaacatctgtagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtttgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggttgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaaatacataaaagccaaggggttagaagtgtgcttatgaaaacttgtat

SEQ ID NO: 894 - DNA, 2089 bp, Homo sapiens
  CDS (70)..(1944)
tttcgtaggagtgacagtctagacgatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctagtaaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgtttt

SEQ ID NO: 895 - DNA, 3062 bp, Homo sapiens
  CDS (196)..(2715)
gagccgtgaggggcgctgcggggaagccacctgcggattcactggctgctgctccgcccaggactgctagcaagcacggagggctgccagacctggggctccctgctccgtgcgtcaggttggggaaaccaccgtctgccccagaccctgacccaggacccgcctggaggaagctgggaccgaggctgggccaagatggcgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggtttttggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccacgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaaataattgacaaatgaggggagaatgctaaacagatgtcttcttgcaatattttaaatattgtatttgagaaaataaacatctgagtcattcaaaaaaaaaaaaaaa

SEQ ID NO: 896 - DNA, 2237 bp, Homo sapiens
  CDS (135)..(1991)
gggaagcccgagcggctgaactcggcagctccaacccaactcggcttaactccgcctcaccgagcccagtccaagactctgtgctccctaggtttgcaacagctctctgatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaataaaaaaaaaaaa

SEQ ID NO: 897 - DNA, 6158 bp, Homo sapiens
  CDS (57)..(4559)
atgattctgacaatggagatattaattatgattatgttcatgaattgtcattggaaatgaagcgtcagaagatacagagggaattaatgaagctggaacaagaaaacatggagaagagagaagaaattatcattaaaaaggaggtttcaccagaagtggttagatcaaaattgtccccgtcaccttctctaagaaagtctagcaaatctccgaagcgaaaatcaagcccgaagtcgtcttcagctagcaagaaagataggaagacatctgcagtatcttctcccctgttggaccagcagagaaattcaaaaaccaaccaaagtaaaaagaaaggaccacgtactcctagtccaccccctcctataccagaagatatcgctctggggaaaaaatacaaagaaaaatataaagtaaaagacaggatagaagaaaaaacaagagatggaaaggacagaggacgagattttgaacgacaaagagaaaagagagacaagccaaggtctacttccccagcaggacagcatcattctcctatatcttctagacatcactcatcttcctcacaatcaggatcatctattcaaagacattctccttctcctcgtcgaaaaagaactccttcaccatcttatcagcggacactaactccacctttacgacgctctgcctctccttatccttcacattctttgtcgtctccccagagaaagcagagtcctccaagacatcgctctccaatgcgagagaaagggagacatgatcatgaacgaacttcacagtctcatgatcgacgccacgaaaggagggaagatactaggggcaaacgagacagagaaaaggactcaagagaagaacgagaatatgaacaggatcagagctcttctagagaccacagagatgacagagaacctcgagatggtcgggatcggagagatgccagagatactagggaccgaagggaactaagagactccagagacatgcgggactcaagggagatgagagattatagcagagataccaaagagagccgtgatcccagagattctcggtccactcgtgatgcccatgactacagggaccgtgaaggtcgagatactcatcgaaaggaggatacatatccagaagaatcccggagttatggccgaaaccatttgagagaagaaagttctcgtacggaaataaggaatgagtccagaaatgagtctcgaagtgaaattagaaatgaccgaatgggccgaagtagggggagggttcctgagttacctgaaaagggaagtcgaggctcaagaggttctcaaattgatagtcacagtagtaatagcaactatcatgacagctgggaaactcgaagtagctatcctgaaagagatagatatcctgaaagagacaacagagatcaagcaagggattcttcctttgagagaagacatggagagcgagaccgtcgtgacaacagagagagagatcaaagaccaagctcaccaattcgacatcagggaaggaatgacgagcttgagcgtgatgaaagaagagaggaacgaagagtagacagagtggatgataggagagatgaaagggctagagagagagatcgggaacgagaacgagacagggagcgggagagagagagggaacgtgaacgggatcgggaaagagaaaaagagagagaactagaaagagagcgtgctagggaacgggagagagaaagagaaaaagagagagatcgtgaaagggatagagaccgagaccacgatcgagagcgggaaagagagagggaacgagacagggaaaaagaacgggaacgagaaagagaagagagagagagggagagagagcgagaacgggagagagagcgagagcgagaacgggaacgagaaagagcgagagaaagggataaagaacgagaacgccaaagggattgggaagacaaagacaaaggacgagatgaccgcagagaaaagcgagaagagatccgagaagataggaatccaagagatggacatgatgaaagaaaatcaaagaagcgctatagaaatgaagggagtcccagccctagacagtccccgaagcgccggcgtgaacattctccggacagtgatgcctacaacagtggagatgataaaaatgaaaaacacagactcttgagccaagttgtacgacctcaagaatctcgttctcttagtccctcgcacctcacagaagacagacagggtagatggaaagaggaggatcgtaaaccagaaaggaaagagagttcaaggcgctacgaagaacaggaactcaaggagaaagtttcttctgtagataaacagagagaacagacagaaatcctggaaagctcaagaatgcgtgcacaggacattataggacaccaccagtctgaagatcgagagacatctgatcgagctcatgatgaaaacaagaagaaagcaaaaattcaaaagaaaccaattaagaaaaagaaagaggatgatgttggaatagagaggggtaacatagagacaacatctgaagatggtcaagtattttcaccaaaaaaaggacagaaaaagaaaagcattgaaaaaaaacgtaaaaaatccaaaggtgattctgatatttctgatgaagaagcagcccagcaaagtaagaagaaaagaggcccacggactccccctataacaactaaagaggaattggttgaaatgtgcaatggtaagaatggtattctagaggactcccagaaaaaagaagatacagcattcagtgactggtctgatgaggatgtccctgaccgtacagaggtgacagaagcagagcatactgccaccgccacgactcctggtagtaccccttctcctctatcttctcttcttcctcctccaccgcctgtggctactgccactgctacaactgtgcctgcaactcttgctgccactactgctgctgccgccacctctttcagcacatctgccatcactatttccacctctgccacccccaccaataccaccaataatacttttgccaatgaagactcacacagaaaatgccacagaacacgagtagaaaaagtagagacgcctcacgtgactatagaagatgcacagcatcgcaagcctatggatcaaaagaggagcagcagcctcgggagcaatcggagtaaccgtagtcatacgtctggtcgtcttcgctccccatccaatgattcagcccatcgaagtggagatgaccaaagtggtcgaaagagagtactgcacagtggctcaagagatagagaaaaaacaaaaagcctggaaatcacaggagagagaaaatctaggattgatcagttaaagcgtggagaacccagtcgaagtacttcttcagatcgccaggattcaagaagccatagttcaagaagaagttctccagagtcagatcgacaggtccattcaagatctgggtcatttgatagcagagacaggcttcaagaacgagatcgatatgaacacgacagagagcgcgagagagagaggagagatacgaggcagagagaatgggaccgagatgctgataaagattggccacgcaacagggatcgagatagattgcgagaacgagaacgagagagagaacgagacaaaaggagagacttggatagggaaagagagagactaatttctgattctgttgaaagggacagggacagagacagagacagaacttttgagagttctcaaatagagtctgtgaaacgctgtgaagcaaaactggaaggtgaacatgaaagggatctagaaagcacttcccgagactctctagccttggataaagagagaatggataaagatctgggatctgtgcagggatttgaagatacaaataaatccgagagaactgagagtctggaaggagatgacgagtccaagttagatgatgcacattcattaggctctggtgctggagaaggatacgagccaatcagtgatgacgaactagatgaaattctggcaggtgatgcagaaaagagggaggaccaacaggatgaggagaagatgccagatcccttagatgtgatagatgtggattggtctggtcttatgccaaagcatccaaaagaaccacgagagcctggggctgcactcttaaaattcacacctggagctgttatgctaagagttgggatttctaaaaagttggcaggttctgaactctttgccaaagtcaaagaaacatgtcagagacttttagaaaaacccaaagatgcagacaatctctttgaacatgaattgggggctctcaatatggctgcattactacgaaaagaagaaagagcaagtcttcttagtaatcttggcccatgttgtaaggcgttgtgcttcagacgggattctgcaattcgaaagcagcttgttaaaaatgagaagggcaccataaaacaagcttacacgagtgctccaatggtagacaatgaattacttcgattgagtcttcggttatttaagcggaagactacttgccatgctccaggacatgaaaagactgaagataataaactttcacagtccagtatccaacaggaactgtgtgtgtcttaagaccgaagttcaatatggtatttttggtactgtcttccttcagcagtgcatattcttttgcaaagttctttggtttgacaagcattagtgacaaaggcagaaaagatttatcagccatgctaaaagagtgaagaattttgatctttagagacactagttttggccaacttaagattttacgttaatttttacatagtatttgacactcatgcaaaataatgtgaaaacatctagatttagtagtttattctgcgccttttgttaaaactgaagattttggaaaatggttgtcactgctcttccagcctatgaatatttttgtgaaatggaaccatggatttatgtctggatcatccatacagaaccaacaattttattcaaaaacaatgtgttcatcaaagtaattgctcacattgtgcagtactatgttgtacagaccacgtgaaagggaatgctggtctagctggcgtggtatgtttataggcgaatttcagcagaaggaagccaaaatagttttttccttttgaaagttttttaaaaattatttcatgggtcttttttttaattaatatgtgtgcattgttacaatgtatgttggatgtcttttgaccctaaatgctttttttgttatcagagattgtgtactatttttatttttaataaatgtatcttccctttccttgttttagatttactttgctcttcgttaatcttattcctgatgatctagaacattagtcatcaacattacatgtttcatgcttcagatattttactgcttgtgtccttattgttggacagctttaaacagagttgatgtacttcaaatatagctcattgatacttaaggcatcttcttggaatgtggcttttgaagaaaaaaattactcaaagcaaatcaagagttaacaaacctaacgtaacctgaggtttaatattctactatcatattttttagagctataacttttgattatattaaactgcctccagctgtactatgtaaaacagatttacttttaaaaattacagtatacctgctttgttctatatgtatatgtttaactcatgaagtggactcttagaaggatttgaaatggactctggccacagaatttgtgagcagacagtagtagtgataataataaaagaaggcaatcaaaatttaattttatcatgccctctcacaggtttgtgttataattgtaagcccatattacttgtgttagtagttttgtctctataggtaacataatgacagtggtgtaaagtttctgttcaagaaacatatgttgtaaagttactttatacaagatacctgccaaaggaaatggtcttactttcaaatgactttgaaagcatgtataattgcaaacagagcaggagaagactttaatcagaatttccttgtgtccttttcctttactaagtgttttgaataaagaaaaaaaaaatgtatgacctcagagaatgaatacccttcaggaagccacttcctgattttagtggataatattgttctctgtagcacaaagatttaaagtcctagaatttctaatcctagttctcagaattgtagaatatgacaaaaataag

SEQ ID NO: 898 - DNA, 2320 bp, Homo sapiens
  CDS (511)..(2190)
cacccctctaggatcccagcccagctggtgctgggctcagaggagaaggccccgtgttgggagcaccctgcttgcctggatgggacaatgtttcctgtggatgtatgaatcacataaatggaaaggaaagagacaaggaagggagaggtcaggagagcgcttgattggaggagaagggccagagaatgtcgtcccagccagcagggaaccagacctcccccggggccacagaggactactcctatggcagctggtacatcgatgagccccaggggggcgaggagctccagccagagggggaagtgccctcctgccacaccagcataccacccggcctgtaccacgcctgcctggcctcgctgtcaatccttgtgctgctgctcctggccatgctggtgaggcgccgccagctctggcctgactgtgtgctgtggcaggccctggcctgccccagccctgtggatttctgtggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctgagggcagggaaggtcaacccacctgcccatctgtgctgaggcatgttcctgcctaccatcctcctccctccccggctctcctcccagcatcacaccagccatgcagccagcaggtcctccggatcact

SEQ ID NO: 899 - DNA, 774 bp, Homo sapiens
  CDS (463)..(657)
gatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttctttgttgtttttaacaattgatatttgaaactttttttttttttggcttcttactggtcttccaatagaacaagaactggcaataaaaggtgattacagtagtaactgggaagacaagttaaaaaaaaaaaaaaa

SEQ ID NO: 900 - DNA, 1714 bp, Homo sapiens
  CDS (277)..(1647)
tttcgtgaactagctcagctccgagctcgcggaaccacgcccccgggagactctggcccggccagcgcgggccaggtcttcagtcctatatcgccctgccttgggaaaaggtgcaggggcctctcgccgcctcgtcgggcccttcctctctacctgcctctccaacccctctcggccccgagccacccggcagcgggggtgggtgtgcagaggtgcggcgtccagaacccggctcctgcagaggctctgggtggcagcagccctgttaccgcttagatggcgcgcaggacagagccccccgacgggggctggggatgggtggtggtgctctcagcgttcttccagtcggcgcttgtgtttggggtgctccgctcctttggggtcttcttcgtggagtttgtggcggcgtttgaggagcaggcagcgcgcgtctcctggatcgcctccataggaatcgcggtgcagcagtttgggagcccggtaggcagtgccctgagcacgaagttcgggcccaggcccgtggtgatgactggaggcatcttggctgcgctggggatgctgctcgcctcttttgctacttccttgacccacctatacctgagtattgggttgctgtcaggctctggctgggctttgaccttcgctccgaccctggcctgcctgtcctgttatttctctcgccgacgatccctggccaccgggctggcactgacaggcgtgggcctctcctccttcacatttgccccctttttccagtggctgctcagccactacgcctggagggggtccctgctgctggtgtctgccctctccctccacctagtggcctgtggtgctctcctccgcccaccctccctggctgaggaccctgctgtgggtggtcccagggcccaactcacctctctcctccatcatggccccttcctccgttacactgttgccctcaccctgatcaacactggctacttcattccctacctccacctggtggcccatctccaggacctggattgggacccactacctgctgccttcctactctcagttgttgctatttctgacctcgtggggcgtgtggtctccggatggctgggagatgcagtcccagggcctgtgacacgactcctgatgctctggaccaccttgactggggtgtcactagccctgttccctgtagctcaggctcccacagccctggtggctctggctgtggcctacggcttcacatcaggggctctggccccactggccttctccgttctgcctgaactaatagggactagaaggatttactgtggcctgggactgttgcagatgatagagagcatcggggggctgctggggcctcctctctcaggctacctccgggatgtgtcaggcaactacacggcttcttttgtggtggctggggccttccttctttcagggagtggcattctcctcaccctgccccacttcttctgcttctcaactactacctccgggcctcaggaccttgtaacagaagcactagatactaaagttcccctacccaaggaggggctggaaggaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaacccttt

SEQ ID NO: 901 - DNA, 2094 bp, Homo sapiens
  CDS (220)..(1959)
tttcgtgtggaaaggagggggccctcctgagtagatctgtgggtgattccttcgaggacgcctcgtcttcccgtctgcccttttatttgtcagcgagggagtccccatggtctctgttcaagttctggaaactttctctttgggtgggcttaatcacctgctactaaatcgtagaactgcccagggccctttctaatattggtcacaaacgtgaggagtatgtcagaaaacagaaaaccgctgctgggctttgtaagcaaactcactagtgggactgcacttgggaactcaggcaagactcactgccccctgtgcttggggcttttcaaagcccccaggctcttgccttgtttgcatacagtttgcaccacgtgtctggagcagctggagcccttctcagtagtggacatccgagggggagactctgacacaagctctgaggggtcaatattccaggaactcaagccacgaagtctgcagtcgcagatcggcatcctttgtcctgtatgtgatgctcaggtggacctgcccatgggtggagtgaaggctttaaccatagaccacctggccgtgaatgatgtgatgctggagagcctacgtggggaaggccagggcctggtgtgtgacctgtgcaacgacagggaagtagagaagaggtgtcagacctgcaaagccaacctctgccacttctgctgccaggctcataggcggcagaagaaaacgacttaccacaccatggtggacctaaaagacttgaaaggctacagccggattgggaagcccatcctgtgtcctgttcaccctgcagaggaactgaggctgttctgtgagttctgtgaccggcccgtgtgccaggattgtgtggtgggggagcatcgggaacacccctgtgacttcaccagcaatgtcatccacaagcatggggactctgtgtgggagctcctcaaaggtactcagccccacgtggaggccctggaggaagccctggctcagatccacataataaacagtgccctccagaagcgagtggaggcagtggcagctgatgtccggacattctcggagggctacattaaggccattgaggagcatcgggacaagctgctgaagcagctggaagacatacgggcccagaaggaaaattccctgcagctgcagaaggcccagctggaacagttactggcagacatgcggactggagtggagttcaccgagcacttgctgaccagcggctcagacttggagatcctcatcaccaagagggtggtggtagaacggctcaggaagctgaacaaagttcaatatagcacccgtcctggagtaaatgataagatacgcttctgtcctcaggagaaagcaggccagtgccgtggctatgaaatttatggtacgattaataccaaagaggttgatccagccaaatgtgtcctacaaggagaagacctccacagagcccgggagaaacagacggcctctttcaccctgctttgtaaggatgccgcaggagaaatcatgggcaggggaggagacaacgttcaagttgccgttgtccctaaagataagaaagacagcccagtcagaacaatggtccaggataacaaggatgggacatactacatttcctacacccccaaggaacctggcgtctatactgtgtgggtctgcatcaaagaacagcatgtgcagggctcgccattcactgtgatggtgaggagaaagcaccgcccacactcaggcgtgtttcactgctgcaccttctgctccagcgggggccagaaaaccgctcgctgcgcctgtggaggcaccatgccaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcaaaaaaaaaaaaa

SEQ ID NO: 902 - DNA, 1735 bp, Homo sapiens
  CDS (214)..(1581)
gcgtggggaattccacgcagccttaagtcggcccaacacggtttctgcctcacggattatttatatatccattgcttattggctgctggcaaacactcgctcttctcgttggctgaaactgtcgggagaagttctgcgaaggctgctccttgcggcgttgggactgagggtcacaggcacctatatttccgtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagaggagttgcaaagacgggctaggcatcttgagaaaaaattcctggaaaacccagacttatctcagacagaggagaaacttcgtggagcagtgctacacgcactacgtaaaactacctaccattggcaagaactgagctacactgagggactgagcctggtgtatatggcagcaagactggatggtggctttgcagcagtctccagagcattccatgagatccgggctcgaaatccagcatttcagccacaaactttgatggactttggctcaggtactggttctgtcacctgggctgctcacagtatttggggccagagcctacgtgaatatatgtgtgtggacagatcagctgccatgttggttttggcagaaaaactactgaaaggtggttcagaatctggggagccttatattccaggtgtctttttcagacagtttctacctgtatcacccaaggtgcagtttgatgtagtagtgtcagctttttccttaagtgaactgcccagcaaggctgaccgcactgaggtagttcaaaccttatggcgtaagacaggtcatttcctggtactggtggagaatggaacaaaagctgggcacagccttctcatggatgccagggatctggtccttaagggaaaagagaagtcacctttggaccctcgacctggttttgtctttgccccgtgtccccatgaactcccttgtccccagttgaccaacctggcctgtagcttctcacaggcgtaccatcccatccccttcagctggaacaagaaaccaaaggaagaaaagttctctatggtgatccttgctcgggggtctccagaggaggctcatcgctggccccgtatcactcagcctgtccttaaacggcctcgccatgtgcattgtcacttgtgctgtccagatgggcacatgcagcatgctgtgctcacagcccgccggcacggcagggatttgtatcgttgtgcccgtgtcagctcctggggagatcttttacctgtgcttactccgtctgcgtttcctccatctacggctcaggatccctctgagagttgatgaggatgtgtaacaagtattttcttctatcgtgcctgccagggctgaagctgcctggtatccaggaggggaatgctggtatccccatatgtctgtgtttgtttgagatttttaataataaataataaatttttgaagaaaaaaaaaaaaa

SEQ ID NO: 903 - DNA, 984 bp, Homo sapiens
  CDS (238)..(543)
atcgagacctcgagcaccctaggccgtgtggcggaattcacagccgggcggccgggcggggacgcgccccggactcttctcagttgagagtgcggttcctgggcaggtttccacaccagttcctttccgcgtccttcggccctggctctggctgcctggcggaggtggggtagcatttgtcatttgcacactgctggctttatctttggggctgcaccccgaggcaacaaatgcaggatgctctgtcacccacatgtccaccaccatctggtttgccttttggctactttgactttctccttaaatgcttcctgtgctgagcaaacattccacagccagcagagcaatggagagttcatggccactcttcccagtatcagcaagcaatttggggtgatcgtttggaagcctcagaggaaagatgtcatcaggcttcctgtggctttgtccttcagcagtggggctcggcttgctttcacctgccttaggaagatttctggcttccgagctctgatatggggagaagataagggctgggatctttgagtctgcccctagctgggtatgtgcgtccggtgtgcgggccttggagtttttggtaatgactcacttgtgctctttctgggatctgtctccctcccacatgaccccgtggggtccctgaatgactgttttagagtacccatgtgggttccctgagtcacagcaggggatgtttaataaggaggttagcactgagcttggggacgtgctgtcacaccagcaggacgctgcaggaaggagcaggctacttcctttcttgacgtgcaaataactcgtataggctaatcaacaggcttataagttaaaagggctaccgctcggccccttggggagttccatcccttcctctgtaacttggagatgtttgtttctgctgcagactcaaagggttgcgatgaagagtggtgggacttatttgagagcttaatccttcgctgggtt

SEQ ID NO: 904 - DNA, 3243 bp, Homo sapiens
  CDS (277)..(2031)
ttgggctcggagcggaagtgagactagggagtctgtccgcctttgttgacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctatcactgatggacaggctggatttggcaatgatactttgagtaaggtgcctggcattagcagtattgagcaaggcatgactggactgaaaactggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgtcgatgtttaattgatcagatctatataagtgggaatacagcatatatctggatattctatttagtatcttttaaatctatttttccttattattatattatttggatctgaagcaatgttgttaataagggcaggttgtatgttgagaaagggtgaaaaggg

SEQ ID NO: 905 - DNA, 3981 bp, Homo sapiens
  CDS (1)..(2496)
atggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaaggaaacgggctgaatggggagctcatccgccaggtgctggcagctctgctccctgtgactggcaggtggcgctcccccggggaaggcttccgccttgagtctgaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaaaaaaaaaaaaaaaaa

SEQ ID NO: 906 - DNA, 859 bp, Homo sapiens
  CDS (44)..(655)
gtagttccagaaaataggactgaccaagaagcagaaaagcaagatgaatgatgtgaagcttgctgtcttgggtggtgaaggaacaggcaaatctgcccttacagtgaggtttcttactaagcgattcattggagaatatgcttctaattttgaatctatctataagaagcacttgtgtttggaaaggaaacaactaaatctagaaatatatgacccttgttctcaaacacagaaagcaaaattctccctcacaagtgagcttcactgggcagatgggtttgttattgtgtatgacatcagtgataggtcttcatttgcttttgcaaaagcgctgatctacagaatccgggagccacaaactagtcattgtaaaagagctgtggaatcagcagtgtttttggttggcaacaaacgagatctttgtcatgtgcgagaggttggctgggaagaagggcaaaagctggcactggaaaaccgatgccaattctgtgaactgtctgcagcagagcagtctctggaggtggaaatgatgtttatcagaattatcaaggacatcctgataaacttcaaactcaaagaaaagagacgtcccagtggatctaaatcaatggccaaattgatcaataatgtatttggaaagagaaggaaatctgtttagtagacaggtaatcctgggagatttcctatatcagagagtttcaaacattcacatgataattaaactaacctttgtatgcaatttttttttggtaaaaagaattctcttggagatatgaaatgattgagtatgaaccacagctgtgttttcaaatatgtagtttgcctttttggttgttgtaccctgctcactctccttcat

SEQ ID NO: 907 - DNA, 3273 bp, Homo sapiens
  CDS (247)..(2361)
ataaaattggctgcccaacattctgaactactaaggggaatttgctgtaggagaaccctaaatctcagaaagagatgacattaagctttgctcttatgggccgagaattagttaatgatttaagcaacttgatttaggggtacctctagtacttctctgctaaagcatttgtccagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatgatcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgaaggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaaggcaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaagtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacttttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatgtgaaaacagacaatattagtttaggtcgggaactgagatattgtaatcaaatagttaacatcaggaagttaatttggctggcttctagggaaacttggccagtgaccagcaaatatatttagaacccttcctgttttatgtctgtacctcgtccacccctcaggtaatacctgcctctcacaggtacagctgtttcttggaaatcctgcaacctagcagttttcctaacttgattagcttgagctgacagactgttagtacagatctctggccacagctgatgggg

SEQ ID NO: 908 - DNA, 683 bp, Homo sapiens
  CDS (140)..(397)
ctccagtcccatgccgggaggtctgggtgttggctggtccattccaggacagctacatctttggcagacctggtgctgacagaaccagctctgatcaggaggacctgcaggtttgttacataggccagtacttcctaaaatgggactctcaggacttctgccaatcctggtaccattcatccttttgggggacatccaggaacctgggcacgctgaaggcatccttggcaagccgtgtcccaaaatcaaagtggaatgcgaagtggaagaaatagaccagtgtaccaaacccagagattgcccagaaaacatgaagtgttgcccgttcagccgtggaaagaaatgtttagacttcagaaaggtcagccttactttataccataaggaggagcttgaataacctccaggatttggctcataatccaggcctctctccacgtgtgcctgattgatgctccaaattggcttccacgggccaaaccttggctgttccagaaactgaaccccaggaattgcttacacactttcttccagcgtagcatctcttcaaacacaatgctcttccccttgaccacttctcagtatgaaactctatgtcttcaactttcagaccccccatttatttgtatgaaggcttcagttgccttaataaagtgctctgtggggtcaaaaaaaaaaaaaaa

SEQ ID NO: 909 - DNA, 1148 bp, Homo sapiens
  CDS (124)..(891)
ttaatctgacaagaaggctagaaagctcaatgcgtcttcctattactctgcatatcttatgtcttccatccaaaaagaatcaacttatcagataaataaccacctcatgaactaagatgaatcatgttccggcttttgtcctcctgctgctcttgcctaaggacaacagaagagacacgaaggaatgtgaccatccctatcattggcttgaacaactctggcaaaactgttcttgtggaggcattccaaaaattacttcccagtaagacagaccattgcatgaaatcggaactgactacacttttgttagatgagtatgaactttccatctatgacctgaatggagacctgaagggccgggaagcatggccaaactactatgcacaggcccatgggcttgttttcgtcctggattccagtgacataagacgcatgcaggaagtgaagatcatcttaacacatctgctgtccgataaaagagtggcagggaaacccatcttaattttagcaaacaaacaagacaagaagaaagccctcatgccttgtgatattattgactatctacttctaaagaagctagtgaaagagaataagtgcccatgccgagtagagccatgttcagccatcagaaaccttgaaagaagaaaccatcagcccatagttgaaggactgcgctggctattagctgtcattgatacttgccaactaccacctacctcgagcatctcaatctccaagaataacacaggctctggagaaagatgcttatcacacagcttctccaccagaacaggaatgtcaaaggagaaaagacagcatctagaacaatgctcaatcgaagctaagcctctaaagtcaatcctacagccatcaaatcaatcctatactcactgagaggctcaagaagagtgagatggcatccgttgagaatgaagaccaccttggtaaaaaagaacagagactttacatctttgtaccgagatgctgctgacaaagcttgtggacaataagtcatgggtgatcaaccaaaactgagccttagaaatacagggttcatttagaaataagtatttttttctttaaggttcttaggcagaaaaggattggcaaaaataaatagaacttctttgctgagaaaaaaaaaaaaa

SEQ ID NO: 910 - DNA, 2912 bp, Homo sapiens
  CDS (304)..(1560)
caacttttttttttttctgcctttgaaatttcttcccatcctctgtgactaagtttgaatccgtatttatatttaattattaaatatattgattttttaccattttgtgtatgtctttagttcaccagtaagattataagatgctgaaaggcaggcactgtgttttctcttgctttatatagtgtcttgcacaaaatagcttttgtcatttgtttgctatgtactagatctccctaaatagtgtaaaattgtttcagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaggcttatacattatatttatagaatataaatttgtcagtggaataaaatttcccctttttttcataaaaatctggtcagggtcatttatatattagaacagttagacacattggtgtctcttttttcctttcctttcgacattggagaattggagtgcagtcataatcttacaagatgttcatttgaatttctcacatttatggtccataaaaacttcaaggcttatccatacttttgatgtttcaatatgcattgaactggatgttatttctgccatatttcaaaatggtagaataaattacagaatttattactactcatttcagtgtttagtacagaaattgccttaaaaattgctattaattgaaatatcatttagttcacattccttaagttgaatcggtagtttcatttcaactgataatagtaaagctatttcagtttagtaaaaattttcttttttccacaagaggaaatgtaaaacagttaagacttgaaattgaaaattcttttaatatttaaaataacttgtttattcaatgtctaaacacatgtcagttttccactggatttttattttcacaggtaaatacactagagtgctagatgcctttttcccctgtcagtttgactttcatttaaatccttcattctgatatcattactgttaggtgaggtggataactataatgagaatctcttattcttcctattcctttgatgaccaaagagataaagtgaagtcatccttattattaaaatgcagcctccaaacaaatttctcaagattccttttccttccttctatccattttctgcccataatttccaagaaaaggtgggtatggaaacacatgagagaatgtgatagtgaagtcatatttacaaaactgagaacatgtccaaaatggattcttgtctcctcttcagaattagccatttaaaatattttctgtgacttcaaattgtaattcttatttgcagttttaccagtcttcatgtacagtgacgaaactgtgtagaaactaaatcatcgctttagtaagaaaggataaaaaggtgtggaagtgaatataaaatgcatctaaacatgacatttaatttgtttataaaaataagacttactaaatatagagtaattcattttgaataggaggctattgtttttatattgtgtaataactcacgtactctgaagagagcttggtcaaacaataaaatacattgttactaaaaaaaaaaaaaaaag

SEQ ID NO: 911 - DNA, 1557 bp, Homo sapiens
  CDS (232)..(1056)
ggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggcccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgagccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggattttttttcccccaaggattttcacacacggaaggagaggtatttcttagagagatcatcattttatggtgccttgaaataaaaatacttctacttgaaatgctgtttaagcaaggcaagtgaattttgttattctgaaagagtttacagaaactattttaataaatgaaatgttcttgtgaagcttttaaaagcaaaatggaacattgaaaaaaaaaaaaaaaa

SEQ ID NO: 912 - DNA, 1759 bp, Homo sapiens
  CDS (248)..(1756)
cggtgtgatcggcgagcacccggagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcttttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcacagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacagatttagcccctccggcagtgttgttcccttgacagagagacacagagccagaagtgagtctcctgggagaatggatgagcctaagcaacccagctcccaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgtccaccactgggccagactga

SEQ ID NO: 913 - DNA, 3442 bp, Homo sapiens
  CDS (847)..(2982)
aacagtatttttacgtttatttgcagcaaatgttgttggctttgtatttaaagtatttatgactcactataaagtgtaggatccaagaaaacgcgctagtttcacttggcccccgtggctgtcccggggagctctccaaggaaggactggttcctgaagttcctggggtgctgcaccaccacggaagaaccaagctccacagagaagccagaagccgcgaccgcggggagctctctgccaggcctccaccgcctcagcggccctttacagccaccgcattctccatgcccccagttatttctagcttcgcacagcgcccggcccaccgagcgacctcaaacctcgcgacactcgcaactcccgaggcccttcctgctactggcctcagagggaagagacatcgggaagattgctccgcccacagaaaggaagatttcgttctcgcgagatcccaatgacaattcgggagcccgttctcgcgggattttccaagaccgggttggaatttgcgggggttaggagacggaagtcagagcctaggaagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggataatacctcttaaacaacttcaagaagtgaaatttggtaaagattgccctatgaatcttatatttgatgatgaagatttagaaaaaccttatttcccaaaccgaaaatttccatcatcctctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggttatttcatttctggctgcagttttgcataaaaagggaactcgtgaggatattgaaaataacatgccagagtttttactaagaagtatgaaaaaggaacccctttcttctacagcaaaaaagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactgggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccggatggtgtattgttctttgacagatttccagaaagctgtctatcaaacagtgttagaaacagaggacgtgactttgatacttcaatcttctgagccttgtacctgtaggagtggccaaaaaaggagaaattgttgttataagaccaattctcatggtgaaacagtgaaaaccttgtatctcagttaccttacagtccttcagaaggtagctaaccatgtcgcgctactgcaagctgctagtacttccaaacaacaggaaacacttatcaaaaggatatgtgatcaggtattttccagattcccagattttgtgcagaaaagcaaagatgcagcctttgaaacactttctgaccctaaatacagtggaaaaatgaaggtccttcagcagcttttaaatcattgcaggaaaaacagagataaagttcttctcttttctttttccaccaagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatggctggtggactaggcctcaattttgtcggtgccaatgttgttgtattatttgatcctacttggaatccagccaatgatcttcaagccattgacagagcatataggattggacaatgtagagatgtcaaagtgcttaggctgatatccttgggaactgtggaggaaatcatgtatttacgacagatatacaagcagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtaaaaaaaaaaaaaaaa

SEQ ID NO: 914 - DNA, 1090 bp, Homo sapiens
  CDS (267)..(917)
tttcgtgccgccctcacctggcgctttgtaccctgaggcagctccggactcagggcaggtgggagggattgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccagcgtggacttgccgctcacccctaatcctcccagtctggatgggccacacttctcccttgacccgggaatt

SEQ ID NO: 915 - DNA, 2562 bp, Homo sapiens
  CDS (136)..(1593)
actccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaaaaaaaaaaaaaatctctatcaagaatgcagagaaagtggaagaaagcagaagagaaactagagcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttcctaaaaaaaaaaaaaaaa

SEQ ID NO: 916 - DNA, 1388 bp, Homo sapiens
  CDS (32)..(760)
gttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctcccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaa

SEQ ID NO: 917 - DNA, 2266 bp, Homo sapiens
  CDS (21)..(1727)
ccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgcaaaaaaaaaaaaaaa

SEQ ID NO: 918 - DNA, 1307 bp, Homo sapiens
  CDS (1)..(279)
atggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtagggcccgtccggagcgggctgcgacccttcccttgcagcccatttctcggctccccacacgtatgtcggctctggcaacctggctgttaaatcggcccttcaatcgctgtctcccatctgtgtagctcctgttttcctccctaatcctgcctgcaccccatttctgctgtcattaccggaagtttgtcctgcactaccctgtgataggctgggggacacaaagatgagaaagacgcgatccctttcctctgggagcttgccgggctgcaggggagtcgagcactcggaggaggataggggaggatatggatgattaatgcggggtcctcacctaagggagcgtaaggggggattgtagaaagggaggcgcagatacgcgagtccacaaatgattgattgataacccttgtttactaagcgcctctcggggccaggagcgcagtcttcggggagtcagacaagtagacgattccactgtggtataaaaagcgtcacgaaggcagctcagggagtagcgagacgctcaggaatgctgtctgcctatgttgagttactgtgtccaagacgctgccaagagggactgggttagagaagaggcaattaggtgtctgcctaccagaaactgaccactcagtgcagaaaacggggaattcgtggagtgggtgaagaaatgagactgtggacaggagggggttcgcagcttacagagaggaatggccctcctctctatgcttcccccctttcttttaattacatacctaaccctcttcacgttggtttttcagcctaagaactctgtttactcaacattctaaattgcttgatgattcccaccacacctttcccatgtatgatttgagtatatgccctcccccacgttgttttatgagagcttttgttgatgttgctggtggtttcctcttcgtttttccttcatctcctctatgctatttgcttaaccattgtggctggacctccttgctctctaaaactggagtggttacggagacagttccagtgaagcttaggatgttccatactggccagtattttcaggtctttgaaatgaaaagatataaaagccggcacttctcagattttgttacggcacgaaa

SEQ ID NO: 919 - DNA, 3940 bp, Homo sapiens
  CDS (28)..(3336)
gaatctccttccacaggtcattattggatgcatcaaccagtatctttctataaactcaaacttaccaacaatacactggaccaagaagggcatatcatcttgcactctatgcatcgttacctgccgaggcttcatttggtgcctgcagaaaaggctgtggaggtgatacaattaaatggccctggtgtccacacttttaccttcccacagactgaattctttgcagtaacagcttatcagaacattcagattactcagctgaaaatagattacaatccatttgccaaaggctttcgggatgatgggctgaataataagccccagagagatggaaaacaaaagaacagctctgaccaagaagggaataatatttccagttcttctggtcatcgggtccgtcttacagaaggtcaggggtcagagatacaaccaggtgatttggatcctttgtcaaggggtcatgaaacatcaggcaagggtttggagaagacttcccttaatataaaacgagactttcttggtttcatggatactgattcagcacttagtgaagttcctcaattgaagcaagagatttctgaatgtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatcaaaggaagctctagacattcatgcagttgatgggacaacagaagaatcttctagtctccaggcatcaaccacaaatgactcaggttacagagcaagaatttcccagttggaaaaggaattgatagaagatttgaagactttgcggcacaagcaggtgatacatcctggtcttcaagaagtgggcttaaaattgaattcagtggatccaacaatgagcattgatcttaaatacttgggagtacagttacctttggctccagctactagctttcctttttggaaccttacaggaaccaaccctgcctctcctgatgcgggatttccctttgtttctaggacagggaaaaccaatgatttcactaagatcaagggatggaggggaaaatttcatagtgcttctgcatctaggaatgaaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagcatccctcaaaactaaacctatccacacaatcataaggaaacgagcccctccctgcaacaatgacttctgtcgactgggttgtgtatgttccagtctagctttggagaagcgccaacctgctcactgccgccgaccagactgcatgtttggttgtacttgtttgaaaagaaaagttgtacttgttaaaggaggatccaaaactaagcattttcagaggaaggctgctcatcgagatccagtattttatgatactctgggagaggaggcaagggaggaggaagaaggaatcagggaggaggaggaacaattgaaagagaaaaagaagagaaagaagctagaatacactatatgtgagacagagcctgaacagcctgttcgacattacccattatgggtaaaagtagaaggtgaagtagatccagaaccagtttatatccccacgccttctgtcattgagcctatgaaaccattgttattgcctcagccagaagttttatctcctactgtgaagggcaaactgctcactggaattaaatctccacggtcatatactcccaaacccaatcctgtgattcgggaagaggacaaagatccagtctacttgtactttgaaagtatgatgacttgtgctcgagttcgagtatatgagcgaaaaaaagaggaccagagacaaccatcttcctcctcctccccatctccatccatttcagcagcaaacttcatgtcattctagccctgcagcaacccatcaatcaatgccaaaggaacctgatttctgcaacagccagccttaaaacaactccaccgtgttgcacttggcaggcatgcattctgcatcaacattcacaagcaaacgcagctggcaagtcttcctgcccatgacaggcagcaatccctctttctcactctctttcatcatgccatcagcaggtccaaccctggttgggtccccacccacaacctgcattggcagcatccatctccagcaacttggccaaacttgtgcgcaggcacgactcgcgcaacacaggattttggagccatcattattccgcagacaccattccattaggccacacatgtcgacacatacacttaaggtggcgcagccttccactcatatgcagtcaggcttctccagcgacaagcagccgggcgtgagatagaaaccctcactggtatattcactccttcgctgttgacacattctcttattggcccatcaatcgttccagcaccacgacaatgacactcggcctgagcacaatcctggactttacgcagacgaccccggacacgttccccatggacccctcttggccacaaatctgcgg

SEQ ID NO: 920 - DNA, 1944 bp, Homo sapiens
  CDS (128)..(901)
ctctagagcggccgcttgggcgcacttgccgggtcaccttgtcccggaggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagaccaacaaagccgtggccaagggggacttgcaccaggccagcaccagctcccggcgggccctattcctggcagtgctgtccatcaccattgggactggcgtctatgtgggcgtggccgtggccctcatcgcctacctctccaagaacaaccacctgtgagcttcctgcgaatggagggggagcacccggggccaggtctgtgtggacgtggaggaagcaggcataccgcatgatgctgtacagtacaaatgattgccaaatgatgccacgaagccctgggatttcctacccatggatttattttgtttttatcctttaatttcatgttcacagcactgtgtagagcaccagacagacgggcactgctaatccttccaaaggaaagctccaaagatcccagcccgcaaggctgtctctggatggattctggtggatgaatggcaacgcggctctctgcagcctgccagtgcccagagtgccaccgcattagcaatatacaaacagtccaaaaaagtgtttattttttatggaatacggtgcaataggcagaggacaagggacacatcactcttctgtctgtggccctgctggagtcctttgtgccccccggagtccacacgccttccctgcaagacgagaatggggctgggaagaaagaggcaacaccacggctggcaggagccccgctgcactgctctgcagacccattggcctgaccctgagaagcagagccagcaaagcccgggacctgcccctctttctttcccttcacaccaccccagcctcaggatgtcaagccacctccggaacgtgtctacactccacagctaccccgcagcaatacgcactcttgggacctcgctgatctaggatggggaggcaggccaccgcccctcccaagactcctcaagaaagagccccgcggttgctccggaaactcgaggcactgcagctatgggcactgcctcagcctaaagacacaggggcgcctcccaatcaccgcgctggcggatgctcaccccgtcataagcagaaactagtgatcctggaaatgagatgggccttactctgtcgactaaatgaatagctattttcttgtcattttttaaagtgcaactcttgcttcatgctgcttaagttaccagatgaatgctgagaaataagtaatcacagacattttaataccaaaaaaaaaaaaa

SEQ ID NO: 921 - DNA, 796 bp, Homo sapiens
  CDS (433)..(705)
  misc_feature (1)...(796): n = a,t,c or g
gacaggcttgccatctttcanaccctggggaagacattgcaactgactggggaggacacagctcatgcacagcttctcgtgcgggccagcccgctgcgaaccctccacccagctaccggagggaggagggaggatgcgctgtggggttgtttttgccataagcgaactttgtgcctgtcctagaagtgaaaattgttcagtccaagaaactgatgttatttgatttatttaaaggctaaaatttttttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctatttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacatttaaaaaaaaaaaa

SEQ ID NO: 922 - DNA, 1568 bp, Homo sapiens
  CDS (1)..(1149)
atggtgctggcgcgggtggcgcgccggccggcggggtctgcggaggcccaggcgtccctggcggggaaggcggcgcttccggagcgtgccaggaagatgtcgagcccgggcatcgacggcgaccccaagcctccatgcttgcctcgaaacggtctggtgaagctgccgggccagcccaacggcctgggtgcggccagcatcaccaagggcacgccagccaccaagaaccgcccctgccagccaccacccccacccaccctcccaccacccagcctggctgctccactgtcccgggctgccctggctgggggcccgtgcaccccggcaggtggaccagcctcagccttggcacctgggcacccagcggagcggccgccgctggccacggacgagaagatcctcaatgggctcttctggtatttctcggcctgcgagaagtgtgtgctggcccaggtgtgcaaggcctggcggcgcgtgctgtaccagcccaagttctgggcaggcctcacgccggtgctgcatgccaaggagctctacaacgtgctgcctggtggcgagaaggagttcgtgaacctgcagggttttgccgccagaggcttcgagggcttctgcctggttggcgtctccgacctggacatctgtgagttcattgacaactatgcgctctccaagaagggtgtcaaagccatgagcctcaagcgctccaccatcacggacgcaggcctcgaggttatgcttgaacagatgcagggcgtggtgcgtctggagctgtcgggctgcaacgacttcaccgaggccgggctgtggtccagcctgagcgcgcgcatcacctcgctgagcgtgagtgactgcatcaacgtggccgacgacgccatcgcggccatctcgcagctgctgcccaacctggcggagctgagcctgcaggcctaccacgtgacggacacggcgctggcctacttcacggcgcgccagggccacagcacgcacacgctgcgcctgctctcctgctgggagatcaccaaccacggcgtggtcaacgtggtgcacagcctgcccaacctcaccgcagctcagcctctcgggctgctccaaggtcaccgacgacggcgtggagctcgtggccgagaacctgcgcaagctgcgcagccttgacctctcgtggtgcccacgcatcaccgacatggcgctggagtacgtggcctgcgacctgcaccgcctagaggagctcgtgctcgacaggtgtgtacgcatcacggacactggcctcagctatctgtccaccatgtcgtccctccgcagcctctacctgcgatggtgctgccaggtgcaagacttcgggctgaagcacctcctggccctggggagtttgcgcctcctgtctctggcaggctgcccgctgctcaccaccaccgggctgtcgggcctggtgcagctgcaggagctggaggagctggagctgaccaactgccccggggccacccccgagctcttcaagtatttctcgcagcacctgccccgctgcctcgtcattgagtagcgcgaggcccccgccccggtcgcgctcgtgc

SEQ ID NO: 923 - DNA, 2088 bp, Homo sapiens
  CDS (227)..(1675)
ggcaggaagcccacggcccacaggggtgtaacccgttacctacctggagcccccagcccttgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggctggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgagggcatgagtgagatctacctgcggtgccaggatgagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctcaagaaaaaaaa

SEQ ID NO: 924 - DNA, 2301 bp, Homo sapiens
  CDS (250)..(1437)
cgcggccgcgtcggacctgtggtcccgggtttctgcagagtctacttcagaagcggaggcactgggagtccggtttgggattgccaggctgtggttgtgagtctgagcttgtgagcggctgtggcgccccaactcttcgccagcatatcatcccggcaggcgataaactacattcagttgagtctgcaagactgggaggaactggggtgataagaaatctattcactgtcaaggtttattgaagtcaaaatgtccaaaaaaatcagtggcggttctgtggtagagatgcaaggagatgaaatgacacgaatcatttgggaattgattaaagagaaactcatttttccctacgtggaattggatctacatagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaatacagagcaactgattttgttgttcctgggcctggaaaagtagagataacctacacaccaagtgacggaacccaaaaggtgacatacctggtacataactttgaagaaggtggtggtgttgccatggggatgtataatcaagataagtcaattgaagattttgcacacagttccttccaaatggctctgtctaagggttggcctttgtatctgagcaccaaaaacactattctgaagaaatatgatgggcgttttaaagacatctttcaggagatatatgacaagcagtacaagtcccagtttgaagctcaaaagatctggtatgagcataggctcatcgacgacatggtggcccaagctatgaaatcagagggaggcttcatctgggcctgtatcggcatgatgaccagcgtgctggtttgtccagatggcaagacagtagaagcagaggctgcccacgggactgtaacccgtcactaccgcatgtaccagaaaggacaggagacgtccaccaatcccattgcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaatgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtatgagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccaaaaaaaaaaaa

SEQ ID NO: 925 - DNA, 2081 bp, Homo sapiens
  CDS (104)..(1918)
agtggtaacaacgcagagtacgcggggggctcggaggggaggctagggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagccccctgtccacccagctttgaagagcacgtgcgcctggccctggagttgtcttcacgggagcaggaggaacgggaacggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcaaaaaaaaaaaa

SEQ ID NO: 926 - DNA, 2165 bp, Homo sapiens
  CDS (104)..(2002)
agtggtaacaacgcagagtacgcggggggctcggaggggaggctagggggccgtgccaggcccgaagccgaggcggggccgggatgcggcgctgaggcccagcatggccggcccgggccccaccttcccgctgcaccggctcgtctgggcgaaccggcatcgcgaactggaggccgcactgcacagccaccaacgaatcccaaccctgctcgccctggcagcctccctgccttgccctcttctctcctgccctttgagagtgtcccgtctcccccagcacgacattgaacaggaggacccccgcgggcggaccccactggagctggccgtgtctctgggaaacctggagtctgtgagagtgctccttcgacacaatgccaacgtgggcaaagagaaccgccagggctgggcagtcctgcaggaggcagtcagcactggagaccccgagatggtgcagctggtgctccagtatcgggactaccagagggccacgcagaggctggcgggcattccggaactgctcaacaaacttcgccaggcccccgatttctacgttgagatgaagtgggagttcaccagctgggtgccccttgtgtctaagatgtgcccaagcgatgtgtaccgcgtgtggaagcggggtgagagcctgcgagtagacaccagtctcctgggcttcgagcacatgacctggcagcggggccggaggagcttcatcttcaagggccaggaggcaggagccctggtgatggaagtggaccatgaccggcaggtggtgcatgtggagacactggggctcactctgcaggagcccgaaacactgctggccgccatgcggcccagcgaggagcatgtggccagtcgcctcacctctcctatcgtctccacccacctggacactcgtaatgtggcctttgagaggaacaaatgtggtatctggggctggcggtctgagaagatggaaactgttagcggctacgaggccaaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagccccctgtccacccagctttgaagagcacgtgcgcctggccctggagttgtcttcacgggagcaggaggaacgggaacggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcaaaaaaaaaaaa

SEQ ID NO: 927 - DNA, 1584 bp, Homo sapiens
  CDS (258)..(602)
aaacagcgtggtcagggaaggcttctccgctaaaggaagtagctacaggaaggcaggatgtgccgggcaggggagacagcaaaggcaacagcctgagaggggaccctgcctgggggtcagtgtggctgagtggcctgagtgaggagcagaaaggggaggcgaggtggaaatgtggggggccagggcctgggcctggctggtggccctgatggcccaggggcctctgtctccccccaacagccctgctcctggacatcatgacggtggccggcgtgcagaagctcatcaagcggcgcggcccgtacgagatgagccccagcctcctggactacctcaccatggacatctacgccttcccggccgggcacgccagccgcgccgccatggtgtccaagttcttcctcagccacctggtgctggcggtgcccctgcgcgtgctgctggtgctctgggccctctgcgtgggcctgtcccgcgtgatgatcggccgccaccacgtcacggacgtcctctccggctttgtcatcggctacctccagttccgtctggtggagctggtctggatgccctccagcacctgccagatgctcatctctgcctggtgaagcgcccgccggcccacacaagcctctgggggcagggctggccctagagaaggggcagggggtggcgaggtggcgggcgtgggtggaacagagcggccaggagtcagagcggccacccccacctcatcttcccctcctggctggaggctggcgaacccaggccacccctcccggagacaagcgtgtttggcagtgccaggcctcttgcccctttgcttggactccaagtctcctctctgggcagccaggacccacccatggggacagccctatttagcttctgctctgggaacagcaaaaatcaggatggtgggaggggccgagtcttgtcttgtcctttcatcatcatgactgttgagttcttggctgtgcccatcacgccacagcacgacgcctgccaaaatgcccccaacctactgcctgatgcaggtgccattgccattagcggtcatcgacagcttagggcagcactttccaacgggtgcccatgggacaccagcctgcgagatgcttttgtgggaaaggggttttgtggttcaataactttcggaagtgctgcacactctgtccccaagttggacattcacaaaggccgttattgccgtaaaggctctgacaagccctatagaaaagcttcttgctaaaccttctttaacccatgttttctaaacttatttgaccacagaacccttttcttggggaacagctattaacccccaaggaattattggttcctcaagtgcgttttgggagctgctgccagagagctaaagggcctggggtgtgagctgactctccgctggggaggccgggtgcacacgccacagcccgaggaaagtgctggccaccgcccgtgggcatcgatgaggctttggcccccaggggccggactccgtgtgacctaataggtcgtttccaagtcacccgttttggatgtgcatttcatgtgacaatacagatgacatgcaaaaaaaaaaaa

SEQ ID NO: 928 - DNA, 1815 bp, Homo sapiens
  CDS (2)..(1066)
gatgggaaaaagacgttgtgttcctccactcgagcccaagttggcagcaggctgttgtggggtcaagaagcccaaattatctggaagtggaacgcacagtcacgggaatcagtccacaactgtccccggctctagttcaggacctcttcaaaaccaccagcatgtggacagcagcagtggacgggagaatgtgtcagacttaactctgggacctggaaactctcccatcacacgaatgaatcccgcatcgggagcgctgagccctcttccccggcctaatggaactgccaacaccactaagaatctggtggtgactgcagagatgtgctgctactgcttcgacgtactctactgtcacctctatggcttcccacagccacgacttcctagattcaccaatgacccctatccgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagataattatactggggtaacatctgacaggaaggacgcaggagcagggagcctggggacagccattatggcatgtgtcgggctatcatctcatgtctcagagtctccacgggactggcagacagactgggcgccagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcatttctcagtaggccgtgaagattttcatcctcatcacactctcagttggattttctggcactcttcctgcattgagtctcctgaattatgaacagagctccgtcatgtagcctgtt

SEQ ID NO: 929 - DNA, 2428 bp, Homo sapiens
  CDS (88)..(1689)
attttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtccccgatcgagacgcctgccgctcccggcagctgtccgcgcccacggtcctatggcggagctaacggactccgcgcggggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaactagagcgaggagaagagccctgggtgtatgaccaggtggatatgacttcagccacagaaagagaggcccagaggggacttagacctggttgttggcatggagtggaggatgaagaggtatcttctgagcagagcatttttgtagcaggagtgtcagaggtcaggactctcatggcagagctggagtctcacccatgtgacatatgtggcccaatattgaaagataccttacacctggctaaataccatgggggaaaagccaggcagaaaccatacttgtgtggggcatgtggaaagcaattctggttcagtacagactttgaccagcaccagaaccagcccaatggagggaaacttttcccaaggaaggagggcagagactctgtgaaaagctgcagagtccatgtgccagagaagaccctcacatgtgggaaaggtaggagagacttttcagccacatctggccttcttcagcatcaggcctctctcagcagcatgaagccccacaagagcactaagcttgtgagtggctttctcatgggacagaggtatcacaggtgtggtgaatgtgggaaagccttcacccgcaaagacacacttgctcggcatcagagaatccacactggagaaaggccttatgagtgtaacgaatgtgggaaattcttcagccaaagctatgacctctttaaacaccagacagttcacactggagaaaggccatacgagtgcagcgaatgtgggaaattctttagacaaatctccggcctgattgagcacaggcgagttcacacgggtgaaagactctatcagtgtggcaaatgtgggaaattttttagcagtaagtctaatctcattcgacaccaggaagttcacacaggagccaggccttatgtatgcagcgaatgtgggaaagagttcagtcggaaacacacacttgttctgcaccaacgaactcacactggagaaaggccttatgagtgcagtgaatgtgggaaggcctttagccaaagctcccaccttaatgtacactggagaattcacagcagtgattatgagtgtagcagatgtggtaaagctttcagctgcatctccaaactcattcagcaccagaaagttcactctggagaaaagccttatgagtgcagcaagtgcgggaaagccttcactcaaagacccaacctcatcaggcactggaaagtccacactggggaaaggccttatgtgtgtagtgagtgcgggagagaattcatccggaaacagacacttgttctgcaccagagggttcatgctggagaaaagctttaagagtgtagcaaatgtgggggaaagtcttaggccaatgcccccgacttactatatggtggggaactagcagtagttaatgagtgcagcagatgcaggaaagccttcccctggaggctgaaccttacccgccattgggaatttcacaccggacacaggccttagcagtctaagcaatgtgctgtctctgttcagcccaacagctcaccctagagtggaactctgggagcagccattgggagggaaccatcagtaagaagtgaaacttcatagatatggacattcccactggggagattccctgtgagtgtcaagtatgtgagatgctttcagcagctgtgttgcactttttaaatggctattggcctttgctggggcaggagccatctgctcctaccatctggcagaatcatactgcgtttaccatttaccccagcatgcttgtgacgggcagacctctcttctctccccagtccctaaaaggtgttgtgagtggtctcacagcccactaggggtcttaatttcctctcttttgatgtaaatggcatggaaataatcagctttgttcaagaggacacagaaggattctgcaaatagcctgcagagacttacctgtgttgattgatttcatatgatgctcgttatggatatatccaatatccaagtcacccagctctggaactgcctgcttcacattgctcatgataataaaggcctgttctttaagccaccatgtatt

SEQ ID NO: 930 - DNA, 2337 bp, Homo sapiens
  CDS (167)..(1564)
agggtcctagcacagtgtctgacggagctttcctaccagaccctgaaattcacgcatcaggcgcgggaagcggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacagcagacaataatttaccgcaaagaagtagagggaagaccagaaggatgatgaacgacagttgtcaaaatcttcccaagatcaatcagcagaggccccggtccaaaaccacagcggggaagacaggggacaccaaatcgctcaataaggagcatcctaatcaggaggtagttgataacactcgcctggaaagtgccaacttcggcctacatatatcaagaatccgtaaagacagtggagaggaaaatgcccacccacgaagaggccaaatcattgacttccaagggctgctcacagatgccatcaagggagcaaccagtgaacttgccttgaacaccttcgaccataatccagacccctcagaacgactgctgaaacctctgagtgcatttattggcatgaacagtgagatgcgagaattggcagccgtggtgagccgggacatttatctccataatccaaacataaagtggaatgacattattggacttgatgcagccaagcagttagtcaaagaagctgttgtgtatcctataaggtatccacagctatttacaggaattctttctccctggaaaggactactgctgtacggccctccaggtacaggaaagactttactggccaaagctgtggccactgaatgtaaaacaaccttctttaacatttctgcatccaccattgtcagcaaatggagaggggattcagaaaaactcgttcgggtgttatttgagcttgcccgctaccacgccccatccacgatcttcctggacgagctggagtcggtgatgagtcagagaggcacagcttctgggggagaacatgaaggaagcctgcggatgaagacagagttactggtgcagatggatgggctggcacgctcagaagatctcgtatttgtcttagcagcttctaacctgccgtgggagctggactgtgccatgttacgccgcctggagaagaggattctggtcgatctccccagccgggaggccaggcaggccatgatctaccactggctgcctcctgtgagcaagagcagggccttggagctgcacacagagctggagtacagtgtgctgagccaggagactgagggctactcaggctcagatattaagctcgtctgcagggaagcagccatgcggcccgtgaggaagatctttgatgcacttgaaaatcaccagtcagaaagcagcgacttacccaggatccagttggatatagtaaccactgccgactttctggatgtgctaactcacaccaagccctccgcaaagaatctggctcagagatactcagactggcaaagagagttcgagtctgtctgaaaccacatttaccctgacctggccacaaaggcaaccacaaagacctcctagtttattaatgtccgtgggagaacaaaatgattggaatggaaaagagaaaattatttttgaagactggattaacttgagccactgtattgttttggatagctgagatatatttattaacttaccattatcgatgtcagcaaaatattgagagtttcagttacatacatatatgtgctattgggtcatacaatggagatttttctgacaattagactccataaaattttaatgaacaattttctgtaatgttactcatttgtaaactttttaagaaaaagatgtacttagaaaagttgtgttggccacacacaggatgaccctgagttggggcagccaagtagaagctaagcttgacaggcactgcccagctgacagtcccagggtgaaggaggacggaagcagggaaggcaatgcagtctgtttctcattccggacaatattctgaatctcatcagctccccctaattctgactccatccagctttgtcagcagcaacccctcccaaactaagccccactcagaaatgtcactgagcattcgatgctagagctaatagcagggttactaagaaccataccatcagctgcagtttgatgttttgggttctggccccatacatctttcacttttaaacctacatcggtgtgcctgccctttcttccatgcggagttccatcagtccaaggttaggtggggacctacatcgggaattcatccc

SEQ ID NO: 931 - DNA, 2394 bp, Homo sapiens
  CDS (347)..(2290)
cgccggttgaagcgtcgccactgagccgtcggaagaccgcccgaccataatttcaggatggcgccttgggctccagcgtctccccaacccctccatgccatgggtccccacgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttggttgccagcaatgttggaagtggacatttcattggcctgccagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccaaaaaaaaaaaa

SEQ ID NO: 932 - DNA, 2475 bp, Homo sapiens
  CDS (347)..(2371)
cgccggttgaagcgtcgccactgagccgtcggaagaccgcccgaccataatttcaggatggcgccttgggctccagcgtctccccaacccctccatgccatgggtccccacgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttggttgccagcaatgttggaagtggacatttcattggcctgccagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccaaaaaaaaaaaa

SEQ ID NO: 933 - DNA, 1757 bp, Homo sapiens
  CDS (68)..(1456)
ctggggtcggcggagacagctggtgtctgaagccgctcgcgcccagggtgaccctgtttgcagcacgatgtctgaagaagaggcggctcagatccccagatccagtgtgtgggagcaggaccagcagaacgtggtgcagcgtgtggtggctctgcccctggtcagggccacgtgcaccgcggtctgcgatgtttacagtgcagccaaggacaggcacccgctgctgggctccgcctgccgcctggctgagaactgcgtgtgcggcctgaccacccgtgccctggaccacgcccagccgctgctcgagcacctgcagccccagctggccactatgaacagcctcgcctgcaggggcctggacaagctggaagagaagcttccctttctccagcaaccttcggagacggtggtgacctcagccaaggacgtggtggccagcagtgtcacgggtgtggtggacctggcccggaggggccggcgctggagcgtggagctgaagcgctccgtgagccatgctgtggatgttgtactggaagaatcagaggagctggtggatcacttcctgcccatgacggaggaagagctcgcggcactggcggctgaggctgaaggccctgaagtgggttcggtggaggatcagaggagacagcagggctactttgtgcgcctcggctccctgtcagcacggatccgccacctggcctacgagcactctgtggggaaactgaggcagagcaaacaccgtgcccaggacaccctggcccagctgcaggagacgctggagctgatagaccacatgcagtgtggggtgacccccaccgccccggcccgccctgggaaggtgcacgagctgtggggggaatggggccagcgccctccggagagccgccgccggagccaggcagagctggagacgctggtgctgtcccgcagcctgacccaggagctgcagggcacggtagaggctctggagtccagcgtgcggggcctgcccgccggcgcccaggagaaggtggctgaggtgcggcgcagtgtggatgccctgcagaccgccttcgctgatgcccgctgcttcagggacgtgccagcggccgcgctggccgagggccggggtcgcgtggcccacgcgcacgcctgcgtggacgagctgctggagctggtggtgcaggccgtgccgctgccctggctggtgggacccttcgcgcccatccttgtggagcgacccgagcccctgcccgacctggcggacctggtggacgaggtcatcgggggccctgacccccgctgggcgcacctggactggccggcccagcagagagcctgggaggcagagcacagggacgggagtgggaatggggatggggacaggatgggtgttgccggggacatctgcgagcaggaacccgagacccccagctgcccggtcaagcacaccctgatgcccgagctggacttctgacccatgggccagtggaggcggggaggaaaggccacctgcacaccccgatccctgctgccccctggtggccacacgtaagctcgaggccttggccttgacccttctttggaatcaggcccaactccggatctctgaccacctttttggtattggactctcccattttttccttgaacacatggacaaagaggcccgggggagcagggcctcgaaccctattcaggccaacttgagccacaagctgggttcttcacctatgtcctgctccctggctccatgaagcgaatccaaatctttc

SEQ ID NO: 934 - DNA, 2339 bp, Homo sapiens
  CDS (96)..(1664)
gcgccggggccgggtagctgctcacaggcgcgcgagctaaccgagtgcggcgagggcctaccaggggcgacagggtttctctccgcaagcgcgcgatgcagcgggcggcggcgctggtccggcggggctgtggtccccggacccccagctcctggggccgcagccagagcagcgcggccgccgaggcctcggcggtgctcaaggtgcggcccgagcgcagccggcgcgagcgcatcctcacgctggagtccatgaacccgcaggtgaaggcggtggagtacgccgtgcggggacccatcgtgctcaaggccggcgagatcgagctcgagctgcagcggggtatcaaaaagccattcacagaggtcatccgagccaacatcggggacgcccaggctatggggcagcagccaatcaccttcctccggcaggtgatggcactatgcacctacccaaacctgctggacagccccagcttcccagaagatgctaagaaacgtgcccggcggatcctgcaggcttgtggcgggaacagcctggggtcctacagtgctagccagggtgtcaactgcatccgtgaagatgtggctgcctacatcaccaggagggatggcggtgtgcctgcggaccccgacaacatctacctgaccacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaagctctttctcctggctgatgaggtgtaccaggacaacgtgtactctccagattgcagattccactccttcaagaaggtgctgtacgagatggggcccgagtactccagcaacgtggagctcgcctccttccactccacctccaagggctacatgggcgagtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggcccatcaaatggctccagacatgttctactgcatgaagctcctggaggagactggcatctgtgtcgtgcccggcagtggctttgggcagagggaaggcacttaccacttcaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactttgcctcgggcctcgcaaaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgacctgtggcatcaggcttctcccagtacaggagggtgccatcccccagcatgcggcttctctgccattagcagccctgggcgggccgaccacactcgaggctgcggtgctacgggcttagccctcgcctccctcactgggagcttccccatcctccctgccttccccagtgggaagttagggaagctcaggagcctgggaccccgcatgtcccaaaatgggattggagaagctggagagaaagcagaagaggccgaggagtgagg

SEQ ID NO: 935 - DNA, 950 bp, Homo sapiens
  CDS (287)..(946)
ctgggccggggacaagcgtgtaggcttcaggtacagggcttcctaagtcaagggtttcaggtcgcactggagaatcattttgcaagcagatgtcataggtctcctcttagactggacggcacgcaaggtcagcgtcagcagatctgaccctaaaaataggcctctgttgccagtgggggtggctgggcgtgcggctgctacatgccccacggaccagaacctcccgacgcggccaggccccggcacacccagctgcagaaaggagagaaaatcccttggctctaaaatgacatctggagaagtgaagacaagcctcaagaatgcctactcatctgccaagaggctgtcgccgaagatggaggaggaaggggaggaggaggactactgcacccctggagcctttgagctggagcggctcttctggaagggcagtccccagtacacccacgtcaacgaggtctggcccaagctctacattggcgatgaggcgacggcgctggaccgctataggctgcagaaggcggggttcacgcacgtgctgaacgcggcccacggccgctggaacgtggacactgggcccgactactaccgcgacatggacatccagtaccacggcgtggaggccgacgacctgcccaccttcgacctcagtgtcttcttctacccggcggcagccttcatcgacagagcgctaagcgacgaccacagtaagatcctggttcactgcgtcatgggccgcagccggtcagccaccctggtcctggcctacctgatgatccacaaggacatgaccctggtggacgccatccagcaagtggccaagaaccgctgcgtcctcccgaaccggggctttttgaagcagctccgggagctggacaagcagctggtgcagcagaggcgacggtcccagcgccaggacggtgaggaggaggatggcagggagctgtagg

SEQ ID NO: 936 - DNA, 1328 bp, Homo sapiens
  CDS (194)..(1117)
ctggttcccagggaggctgggggtgattcaccacactcttaaaagaagactagcctcatttcctccccagctcatggggtaggattcctctgctctggcagcagatctcccagagggagcagcctgaccacatcactggcccagaagaggaggcgtctgtcccccagactagctgaaggaaaggctggcttggatgatgctctgctctctccttgcccttctcctgggcactttctttggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctcctcctcagtgactctggcttctatctctgtgcctggagtatagggggtggacgtgaaaaactgttttttggcagtggaacccagctctctgtcttggaggacctgaacaaggtgttcccacccgaggtcgctgtgtttgagccatcacaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacgggtgaaatctccctaacccagggggaccttagcatgcctaagtgactaaacccataaaa

SEQ ID NO: 937 - DNA, 2313 bp, Homo sapiens
  CDS (101)..(1273)
tttcgtgaacccgctgcctggctggagctctctgggcccttcggtctcggcagcaacgcgttcccggcgacttctgacacagccattacctagattcaagatgaatagcgatcaagttacactggttggtcaagtgtttgagtcatatgtttcggaataccataagaatgatattcttctaatcttgaaggaaagggatgaagatgctcattacccagttgtggttaatgccatgactctgtttgagaccaacatggaaatcggggaatatttcaacatgttccccagtgaagtgcttacaatttttgatagtgcactgcgaaggtcagccttgacaattctccagtccctttctcagcctgaggctgtttccatgaaacagaatcttcatgccaggatatcaggtttgcctgtctgtcctgagctggtgagggaacacatacctaaaaccaaggatgtgggacactttttatctgtcactgggacagtgattcgaacaagtctggtgaaggttctggagtttgagcgggattacatgtgtaacaaatgcaagcatgtgtttgtgatcaaggctgactttgagcagtattacaccttttgccggccatcctcgtgtcccagcttggagagctgtgattcctctaaattcacttgcctctcaggcttgtcttcgtctccaaccaggtgtagagattaccaggaaatcaaaattcaggaacaggttcaaaggctatctgttggaagtattccacgatctatgaaggttattctggaagatgacttagtggatagttgcaaatctggtgatgacctcactatttacgggattgtaatgcaacggtggaagccctttcagcaagatgtgcgctgtgaagtggagatagtcctgaaagcaaattacatccaagtaaataatgagcagtcctcagggatcatcatggatgaggaggtccaaaaggaattcgaagatttttgggaatactataagagcgatccctttgcaggaaggaatgtaatattggctagcttgtgccctcaagtgtttggaatgtatctagtaaagcttgctgtggccatggtgctggctggtgggattcaaaggactgatgctacaggaacacgggtcagaggagaatctcatcttttattggttggggatcctggcacagggaaatctcagttcctcaaatatgcagcaaagattacaccaagatctgtgctgaccacaggaattggatctactagtgcaggtattgtatgtgacaatttcaagtaatttaacattacttcagaagttaacacaatggttttttctaatgaaaaactacctataataggataaatttcaagctaatttttgagttaccactaaaaatggaaggaaatatgcaatgttattttggtagctctaagaaaatatcttgcaagctccaccttcactttgcatcttagttttgaacaatcctattcaattttctcattctctagtgattaccttcatacttttatgcaggaaaaagtccgtatcatctggcattttatcaagactcagcaactggaatgttaaactaaagagggggatatttcactttaccaagtagatagatggtatagagcttaaggcattttcatgctcataaatctgataggcaacagtagctcctactgaaatttcttaggtagggaatgtttattaatatttggaaaatatacttccatcattgcaatgtggagcttcattcataagttgtaatgattctttagcaagtacacttaaaagcctttgcaggtagaatgtcaagatttgattataaataaagtgacccagggaatttagaaaaaaattattttaaaaaatatgtttgatgctattttgtatttttacagttttgattgggtaatgtttctgttcttctgaaaacagacccttggcttcacacattttaaaaatgtttgctacttgttaagggagtcagattaacttccattgggctaatgaatgctcaaatttctaatgagaaactaacactttaaaatttatcatacaacagaaaatggccaattaatggtcctgtataagtggaaaactgttaagggggtctcaggttttgaaatataactcaacagtatattaaccattgacaagaatggatttttggaattgagaagggtagacaaacttcaggatactaggcaagaatatataaagaatatttcccatgcgttttaaatccgtatgacccagtgttctagagttctgtataaaatgataccaacaacaaataaagatgcttcccaagtaaaaaaaaaaaa

SEQ ID NO: 938 - DNA, 1934 bp, Homo sapiens
  CDS (201)..(1874)
tttcgtgcggggggctgttcgggtggaggcgggggagccgccgggacaccaaaataggagctgcttgtggggtggagcggcactagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatttttccagtgccatgcgggctcatgggtgtgtttgtgtgtataaagcctaattgaatctgcagaaatgaccaagcaatcactttttttggagatagttttataaaaat

SEQ ID NO: 939 - DNA, 4646 bp, Homo sapiens
  CDS (10)..(4557)
gctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgccgagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggagtggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggagggtcctccccgccatcatctcagaatgccacgctgccttcttcgagtgcctggccactcagtgcctccggctacagtagctctttcagcagcattgcatccgcacctagtgttgcaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagc

SEQ ID NO: 940 - DNA, 4529 bp, Homo sapiens
  CDS (10)..(4440)
gctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgccgagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggagtggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccgcttcccccctggagcagaaccctagcaagcatggtgctatccctggaggtctaagcattgggcctccaggtaagtcctccattgatgactcctatggccggtacgatttaatccagaacagtgagtcaccagccagtcctcccgtagctgttccccatagctggtcacgtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagc

SEQ ID NO: 941 - DNA, 4355 bp, Homo sapiens
  CDS (10)..(4266)
gctgttggtatgggggccatcatcccgccccacctgcaaggccttcctggtgctaatggatcatcagtttctcaagtcagtgggggcagtgctgaaggaataagcaattctgtgtggggactgtccccaggtaaccctgccacaggaaatagcaattctgggttcagtcaggggaatggagacactgtgaactcagcattaagtgctaaacaaaatggatccagcagtgctgtgcaaaaggaaggaagtggaggaaatgcttgggattcaggacctcctgctggtcctggaatactcgcctggggaaggggcagtggcaacaatggcgttggtaatatccattcaggagcttggggccaccccagccgaagcacctctaacggtgtgaatggggaatggggaaagcccccaaaccagcattccaacagtgacatcaatgggaaaggatcaacagggtgggagagtcctagtgtcaccagccagaaccctaccgtacagcctggtggtgaacacatgaactcctgggccaaagcggcatcttctggaactacagcaagtgaaggaagtagtgatggttctggcaaccacaatgaaggaagcactgggagggaaggaacgggagaaggccgaaggcgagataaagggattatagaccaagggcacatccagttgccaaggaatgatcttgacccaagagttctgtctaatactggttggggacagactcctgtaaagcaaaacactgcctgggaatttgaagaatcccctaggtctgaaaggaaaaatgacaatgggacagaggcctggggttgtgcagctactcaggcttcaaactcaggggggaagaacgatgggtccatcatgaacagtacaaatacctcttcagtatctgggtgggtcaacgcgccacctgccgctgtgccagcaaacacaggttggggagacagcaacaacaaagcgccaagtggcccgggggtttggggggactcgataagctctactgctgttagtactgctgctgctgccaagagtggccatgcttggagtggggccgcaaatcaggaggacaagtcacccacctggggtgagcctccaaagcccaaatcccaacactggggagatggacaaagatcaaatccagcctggagtgcaggagggggagattgggcagattcatcgtctgtccttggacacttgggggatgggaaaaaaaatggatctggatgggatgctgacagtaataggtcagggtctggttggaatgacaccacgagatctgggaacagtggctggggcaacagcacaaatacaaaggccaatccaggtacaaactggggggagactttaaaacctggcccccaacagaactgggctagcaaaccccaagacaacaatgtgagtaactggggaggagctgcttctgtgaaacagacaggaacagggtggatcggggggccggtaccggtcaaacagaaggacagcagtgaagcaactggctgggaagaaccctctccaccgtccattcgccgcaaaatggaaattgatgatggtacctcagcttggggggacccaagcaactataacaataaaactgtaaacatgtgggatagaaacaacccggtcatccagagcagtaccacgaccaataccaccaccaccaccaccactaccacgagcaacaccacacacagggtcgagacgccgcccccgcaccaggccggtactcagctgaatcgatcaccgttgcttggtccaggtaggaaagtttcatcaggctggggagaaatgcctaatgttcactcaaagactgaaaactcttggggagaaccatcctccccttctaccctggtggataatggcacagcagcatgggggaagccacccagcagtggcagcgggtggggagatcaccctgccgagccgccggtggcatttggaagagctggcgcacctgttgctgcctcagccctgtgcaaaccagcttcaaaatctatgcaagaaggctggggcagtggtggggatgaaatgaacctcagtaccagccagtgggaggatgaagaaggggacgtgtggaataatgctgcttcccaagaaagcacctcctcctgcagctcctgggggaacgcccccaaaaaaggacttcaaaagggcatgaagacgtctggcaagcaggatgaggcctggatcatgagccggctgatcaaacaactcacagacatgggcttcccgagagagccagctgaggaggccttgaagagtaacaatatgaatcttgatcaggccatgagcgctctgctggaaaagaaggtggacgtggacaagcgtgggctgggagtgaccgaccataatggagtggccgccaagcccctcggctgccgcccgccaatctccaaagagtcttccgtggaccgccccacctttcttgacaaggatggcggcctcgtggaagagcccacgccttcaccgttcttgccttccccaagcctgaagctccccctttcacacagtgcactccccagtcaggccctgggtgggattgcctccgggctgggcatgcaaaacttgaattcttctagacagataccgagtggcaatctgggtatgtttggcaatagtggagcagcacaagccaggaccatgcagcagccgccacagccaccagtgcagcctcttaactcttcccagcccagtctccgtgctcaagtgcctcagtttctatcccctcaggttcaagcacagcttttgcagtttgcagcaaaaaacattggtctcaaccctgcactattaacctcgccaattaatcctcaacatatgacgatgttgaaccagctctatcagctgcagctggcataccaacgtttacaaatccagcagcagatgttacaggcccagcgtaatgtgtccggatccatgagacaacaggagcagcaagttgcgcgcacaatcactaatctgcagcagcagatccagcagcaccagcgccagctggcccaggccctgctcgtgaagcagccaccaccgccaccgcccccgccgcacctgtctctgcacccctctgcaggcaaatcggccatggacagcttcccctcgcacccacagactcccggcctacctgacctgcagaccaaagagcagcagtcttcacccaacacctttgctccttaccctctcgctggactgaacccaaacatgaatgtcaacagcatggacatgaccggtggcttgtcggtgaaggacccatcccagtcccagtcacgcctcccccagtggacgcaccccaactccatggataacttgcccagtgccaaatctgacagtgataaaatctcaaatggctctagcatcaactggcccccagaattccatccgggagttccatggaaaggactgcagaatattgaccctgagaatgaccctgacgtcactcctggcagtgtccccactgggcctaccatcaacaccaccatccaggatgtcaaccgctacctcctcaagagtggaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggttctgcctggagcaccgacacctcaggaagaaccagcagctggctcgttcttcgaaacctcactccccagattgatggttctacactgcggacattgtgtttgcaacatgggcctcttatcacattccacctgaatctgactcaaggcaatgctgtggtccggtacagctccaaggaggaggctgccaaggcccagaagtctctgcacatgtgcgtcctgggaaacactaccatcctggccgagttcgctggtgaagaagaagtgaatcgcttcttagcccaaggccaggcgctgccacccacttccagctggcagtccagcagcgcgtccagccagccgcggctcagcgcagcgggcagctcccatggcctggtacgcagcgacgctggccactggaacgccccgtgcctgggtggcaaggggagcagtgagctgctgtggggcggggtgccccagtactccagcagcctgtggggcccgcccagcgccgacgacagcagggtgataggcagccccacgccgctaaccaccctgctgcctggggacctgctcagcggggagtccctgtaggctctgccatcatcagcaccaggagagccgacccctcccgggacccctcccggctgggcggccccacagacccgctggaacccagc

SEQ ID NO: 942 - DNA, 1937 bp, Homo sapiens
  CDS (188)..(1798)
aacgcaggcttccggatcatcctgggaaaaagctctaatcgttaaccccagagcgcggtggctaaaccgggctccggcgcctcccccagaagcccttttttaatcgttcatacggaccctggtcgacttcgccggagactgccagatctcgtgccttttccctgggggatcttcttaattataaataatgggggatgattataaaacaatttcttttgaagattctgaaccatccacaggaaggaattacacgccctccgtgcctccagaagcacaggaggagaccgttatgaatctcaaagggatagatgcgaatgaaccaaccgaaggaaggattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggaagcgcggattctattactggaaactttgggactgaaaggccaaagcttctgggcccaccatcaacgcagctccgctttcatttctttcacatacaactttccacataagatttcatgcggaaaaaaaaaaaa

SEQ ID NO: 943 - DNA, 2270 bp, Homo sapiens
  CDS (369)..(1481)
gctaggtgaggcctggtgttaatcggccgaggcacttagtgcctgcccatgacgcttccctcgtgggctgccacctgggtcgggctgcggctgcctgtggctcgcgggccttccccgcgccggcgcggcccaaccgccaccgaaccttctggaagcggcggctgcctggtgccctcacgccgccatgaatctgtacgcccgcgctgagctctctgcagccttgtgctggcctggtgaggcggggctctggggtggtggccggcgcgggggcggtggtcggcgctggtggaggccgcgttcgattctgcccccgtgcgcgcaggccccgcctcaccagccccatcgctccacctctgccctccccctttatggcgcggccctgggctcattcattcctgcgccgtggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctggacccacgtgtcctgggtggtcatttgtcttgggggggctgctttcccagggggtgtgggacattggggctcccgtggacagtctcagccctcccagcaccagcacctgcatgtaccctagaacctcaggcacagcacaccgattggtgtccggctggtgacttgctggctatgaatgcccatttcccgtgggtccctggtttggtgtcctggccccagacaccctggctccctggacctcataggcagcccagatgctgggaggatgtgggctcagggccacgctgcctggtgggagtgccagcaccccacaacccccctgtctggcttgcagaggatgccggctctgagcctgtgtggctttcctatgaacagggtggggctgctgggaaagactcagcgaggtgatggtgtgggaagagcaaatgtggctggctcagcgtgttggagcccaccctgaccc

SEQ ID NO: 944 - DNA, 1299 bp, Homo sapiens
  CDS (14)..(979)
tttcgtcgaggcgatggcgccctgggcgctcctcagccctggggttctggtgcggaccgggcacaccgtgctgacctggggaatcacgctggtgctcttcctgcacgataccgataaaagtgcagatgaactgctggccacacacagccactcatggaaccaacatctccaggcctttgctcagccaggaacacacttccccacctccaactgcaccccaaccccacccactcctgttctacccggcccagcctcactgtgctctccggcctctccagagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaaaaaaaaaaaaa

SEQ ID NO: 945 - DNA, 1001 bp, Homo sapiens
  CDS (56)..(742)
ctctaccccttggagactgcttttctccagctctgtcaactcaacctttcccaccatgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctggagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagaggtgagcaggctccacccgagggtcacagaccatgtttcccgtgcctctgggctcacctgatctctgtgccattattttttaggagatgggggggtatgctccagggtcaggagctcacatccctttctctggctagggggaagggcctatcctctttgatgataacttcctgcctagttgacaggaagcagttcctgtgctccttgacccactgaaatgttcagttgctggtgtcgggagcccgctgtcgttgttctgag

SEQ ID NO: 946 - DNA, 1822 bp, Homo sapiens
  CDS (125)..(1612)
aaccgggggcgcggcggcggcgagggctcggcgggccattggctaccggccgcggcaaaggcagcttggggacccagcgtgcgcggggcccgcgggccgggccggggtgacctgggctgcagccatggaagaacagagggaggccctgaggaagatcatcaaaacactggctgtgaagaatgaagaaattcagagctttatctactccctgaaacagatgctgctgaacgtggaggcgaactcggcgaaggtgcaggaggacctcgaagcagagttccagtccctcttctccctcctggaggagctgaaagaaggcatgcttatgaagataaaacaggaccgtgccagccgcacctacgagctgcagaaccagctggctgcctgcacgcgggccctggagagctccgaggagcttctggagacagccaaccagactctgcaggccatggacagcgaggactttcctcaggctgccaagcaaatcaaagatggagtgaccatggcccctgccttccggctatcattgaaagcgaaggtcagtgacaacatgagtcacctcatggtggacttcgcgcaagagcggcagatgctacaggcactcaagttcctgcctgtgcccagcgcacccgtgatcgacctggctgagtccctggtggcagataactgtgtgaccctggtgtggcgcatgccggatgaggacagcaagattgaccactacgtgctggagtaccggcggaccaacttcgagggcccgccccgcctcaaggaggaccagccctggatggtcatcgagggcatccggcagacagagtacaccctgacaggtctcaagtttgacatgaaatacatgaacttccgtgtgaaggcctgtaacaaggcagttgcaggagagttctctgagccggtgactctggagacaccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccagaggtactccatctcccaagaggatgccctcaggtcgtgggggacgggaccgcttcaccgctgagtcctacacagttctgggggacacgctgatcgacggcggggagcattactgggaggtgcgctacgagccggacagcaaggcgttcggcgtgggcgtggcctaccgcagcctgggccgcttcgagcaactgggcaagacggccgcctcctggtgcctgcacgtcaacaattggctgcaggtcagcttcacggccaagcacgccaacaaggtcaaggtgctggacgcccccgtgcccgactgcctgggtgtgcactgtgacttccaccaaggcctcctgtccttctacaatgcccgcaccaaacaagtgctgcacactttcaagaccaggttcacacagccgctgctgcctgctttcacggtatggtgtggcagcttccaggtgacgacaggcctgcaggtccccagtgctgtgcgctgcctgcaaaagcgaggcagtgctaccagcagctccaacaccagcctcacctaggcccccaggcacccacccagctggggtgtttttgggggagtcgccgccaagcccaggctgctggagccaggcaccctcctctgtcacttgctgcttggagccttaactccagatgggggggtcaccaagagggagtgggcaccctggcgggccctctccccacctcacctcttaataaaggtcagacactggcaaaaaaaaaaaaaa

SEQ ID NO: 947 - DNA, 3959 bp, Homo sapiens
  CDS (714)..(2183)
tactactactaagttcgcggccgtcggacgatggacagtccgaactccctgccgaggtacccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaattccctaaaagcgcctctttggacactgaggccctctctgcctttcctggcctccggcaacagttttttacaaagattttttgcagtcgagtccatatgtccacccattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaaaaaaaaa

SEQ ID NO: 948 - DNA, 1854 bp, Homo sapiens
  CDS (175)..(1083)
cccgggtcgacgatttcgtagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttattta

What is claimed is:

1. An isolated polypeptide encoded by the polynucleotide of SEQ ID NO: 380.

2. A composition comprising the polypeptide of claim 1 and a carrier.

3. The polypeptide of claim 1 wherein the polypeptide is provided on a polypeptide array.

* * * * *